United States Patent 9,486,487 (METHODS AND COMPOSITIONS RELATING TO MICROBIAL TREATMENT AND DIAGNOSIS OF DISORDERS) - sequence listing, part 13

SEQ ID NO: 12 - DNA, 3443606 bp, Eubacterium hallii WBS-01 (residues 1,721,804-3,443,606 of 3,443,606)
aagacaacctgatcatatgccaacatttctcattatggaaatcgatgatgaaggcgaggcacattacggacacggatattataaatccaaatttaccgaactgaaaatttaaaaaataatataaatgtactcgtgcaagaaagccggggcgttcttgaatataatggaaaaggatgtacattgcagcatcctttccattttttgtgtatatagaaaggaattattttatgaaaaaaggagatatttttgaggggaaagtcatccgaatcgaattccctaataaaggaattatagatattgaggggcagaaagtaatcgtaaaaaatgcgttagaaggtcagatagtacgcttctccattaataaaaagaaacgagataaaatcgaaggaagacttcttgaagtcatcgagccatccccgatagagcagccagcagcctgcaaacattttggaatttgcggtggctgtcgttaccagaatctttcttacgaacagcagcttgacttaaagaaacgtcaggtagaagaactgatcgaaaagaacggtctttcttttgatatcgaaaatatctatggaagcccgattacagaaggctaccgaaacaagatggaattcacatttggtgacgaagaaaaagatggcccgcttgcactcggaatgcataagaaaaacagcttctatgatatcgtaacattagacgattgccgcatcgtagaccctgatttcaacgtacttcttcaggcaatcttaaaatacttcaaagaaaaaggcgaaacctacttccacaaaatccgccacgaaggatttcttcgtcatcttgtaatgcgccgttccgtaaaaacaggcgatattttaatcaatcttgtcactacgacacagagcagactggatgaatctgaatttgtcaatatgattctctcccagaaaattgatggaaaagtagtcggcattctgcacacattaaacgacaaccttgcagatgttgtacagagtgacgagacaaaaacactctacggacaggactatttctatgaatacctttacaatatgcgtttcaaaatctccccgttttccttcttccagacaaacacattaggagcagaagtcctctacgataaagtaagggaatacgtcggcgaaacaaaagacaaactcatctatgacctctacaccggaaccggaaccattgcccagatgctcgcctcggtagccagcaaagtagtcggagtcgaaatcgtcgaagaagccgttgaagccgctaagaaaaacgcagtggacaatcacttagataattgtgaatttatcgctggtgatgtcctcaaggttgtggataacttaactaagaaaccagatatccttgtacttgaccctcctcgtgatggtattcatccgaaggctttgacgaagattattaactttaatgttgatgaaatggtgtatgtaagctgtaagcctactagccttatgcgtgatttgcttgtgtttagggaagcagggtatgaggtgaagagagcttgtttggtggatatgtttcctggaacggtgcatgtggagacggttgttcttttgtcccaacaaaaaccagatgacacgatagagatcgacttagacctggacgagctggatgccaccagtgccgagttgaaagcaacctatcaggaaatcaaagattatgtgctgaaagaatttggcttgaaggtttcaagtttatatatttctcaggtaaaacgcaaatgtggaattgaagtgggagaaaactataatctttcaaaatcagaaaatgcaagagttccgcaatgcccgaaagagaaagaagatgctatcaaggctgccctgaaatattatgcgatgatctaaggacatcgctgatttcaaggaggaataacacatgaaaagcacatttgaaaaaatgggtggaacctacacacttggcgcagacggaatttactatccgaatcttgtcagtacagatgaagaaccgcattatgggaaatatggaatgatgcggaaaacatatctgaaagagcatcgtccggcaatgtattcactgtatatgctggaagacagactgacagaacatctgaatactgtggacgatgaagcacaggagagaatggatattctggtgagtcagatgatggagaagcagggcattacggaagaattgaaagctcgtgaccagatggaatgggttagagcggtaaataatgtccggaattctgcagaagagattgtgcgtcatgaaataatttataaataatagctgagggactgttggacagtccctttgttatttcttggcagctaaaattggtgacaggtgttaatgacataattcgcgttaaatacatatattttatttgatttttattgaaatgagctatggtaaagctgaaaatcgtaaaaaaatacgaaaatataaaataactattgacagattggatgggggaaggtataatccaagatgtagaaaggtatggtgtaattatgtttgtttcattttcagtaggaaatacaggtccattcaaggagataactggaatcacaacccttgcggagaatttgaaaaaagagttcttagaggaaaatacatttgaagtctctggacagaactataataaaatttcatacatttatggagcaaatggttctggaaaaacaaattatttggcagcacttacgaaaatgcagaagatgataataatgtctactgtgttgggagctaataataataagctattagaagttcctgcaattaagaaagaactagcagcaccaatcgaaacttttaagtttgatattgattgtaaaagtaaagagacgtattttgagattcaggtgattatcgaggaaattttatacacttattcatttgcaattcaggatggaaaaattcaaaaagagcttttgaccaaaaagaagaaacggacagaagtacttattaagaggacttctccaaaatatgaagacatagtacttcgctccggattgtctagtttcaagaatatggtatctgttgttagagaagacgcattatgcttggcaatggcggctatgttaaacaatcctttagcaagtatgattctgaatgaaataatgaattatcgtgtgataaatatggcttcggttggaaatgcaccggattttgatgaagaaaatactaatgaggaagcaatagaaagatatctcaagtatttaaaaatagctgatcccacattgacaaatttaaaggttgatttggaatcaaaaatggataaacatgtattgagtgaagacgatttagagaacaaagagctggtcatcaaaaacatacatgtaagtgttcaatcacttcatgctacttacaaagatcataaacaagttggggagatagaacttccatttttgaagtatgaatcaaatggaactattcgaatgctgagagttttacctgctatttttgaggcattagatgctggaagtacgttatttattgatgaaatagagaatggtttacatcctaatttagtaaagcttttagctggtttgtttaattctaatgaatctaatccgcatcatgcacagttaatatgtacaacacatgacacactgctactcgatggagtacggagagatcaggtatggtttacagataagaaccagtatggagaaacaagcatgtgcagattaagcgattatccaaatgtgagaagcaatgataatattgctgcgaaatacttacaaggagtatttggagcgattcccaatactcagaatttgtaataaaaaaagaaccaaagcgccaactttggttcaggtggtagatatctaccaaatgtagtaaccatgggcgaaatgaccatggcgcaatataaaataatccaaaccaataataccatggttactacaaactttcaataaaaatttaatacaggagagataaaatatatgacggaattgtagtaatatggtagctattgcgccattaaatttataagtactttggtcatttctccttttcatatagatatattttttatataaaatggaggaaataatttgattattaaaaagaaaagaattaatagtttatcatgtttgaaccatgttgaagagggaaagaatctgatgatggtactacgtgatgcagcgagatttaaagggatattagtgaaactgggattttcggaggatttaattgaaggcgagagagttttaccatccatgttaaatccgacgctgaagagaaatgcagagcctttttatattaaggataaaacaaaaccgaaagaacagtatacacaaactttatggtggacgcgacatgagtgggcaggccgtggagagacaagagaggtgacggattttgttaccattcctcgtgagagatatgcaagaataaaattcgagccatacagtgtggaattgttcttgaaatatgatgaacaaggccagttgatggtaatgacggatttcatttcatattgtcatgataatgaaaagttgctgataaatacgattaatatttttcttactaattttgaagagtgtgaaatattaactgagaattttgaaaatgtgatgcctacccgaattataaagctgaattgggaagtgttaccaagtggagattatccgtggaaaaggatgcaagatgatttacaaaaagtatctgctaaaagtagtaagactgcgaaaaaattgctaattgataaatgtgagtttataaattcttttcagcctgattttagagcatatgggaaatctggatttcatgggtatgtgatttttggattcatgcataggaacatatatgttttggaaagcgtttatccgaacaatgccacatatgtttttggaaaaaattgggaagaactttcaaaacttactaaagccgaaattttaaaagagaatttgcaagatgtacgaataattcataataataattggcaacaagaaatacgtgatttgttggaggtagcataaatgggaaaaaatcaacatgtaacgccacataaagaaggtggctggcaagttaagggtgagaacaatacaagagcaacagttagaactgatacacaggctaaagctatacagagagcacgagaaatagctaggaaccaagaatctgaactgtttattcatggaaaaaatgggagaattagagaaagagattcatatggaaatgatccgtttccgccgagaggataaactataataagtaaacaaagagctgaacagataggacgaaaactcctatttgttcagctcttgtgtttataagaggtcaaagaagaaacaaattataattccatatcatgtgaccttttcttagatcgaataggctgatttcgtcgcatctcctgtttcctctgatattcaagttcccatgcacgatgagagaaaacatcaggatcctccacattgagataatccacctcatcggctgcaatatcacggcggtgatagtcataatacttaccgaaagtacctttgagctgttcgatcagcttatcccgaaaatcaggacgtatctggattctggtgtccagcaattctgtatactgttcaggttcaggacgaaatttttcttctcggaaagcggcagcatctttttcaagctgttttttgagcgagatgccctgagaatctaggatatcaagattgttcttcatctggtcgtatttcttggatagattcgtcatatctttatctgtagagcattctgcctggaagattagctgctctttccttgatttcagttcttcgatttcttcggtaatagtggtaagctgctgatttaattttatatgctggatgggattcaaaatactggttttatccttttgcacattcagttctttccgttctgtaactttagctttgagtttctttttaacggtgttgtatttattcagtattggattaaaatgattcatccagtcatggatcacttttttttgcatctcattgtggagcaaatgatattgtgtaaaaatcatgtgatttcggattgcttccaatgtttctgcaattattggaatagacttttctacagcttcagccagttttgctacttttgcttttaattctcggagcattttgttatccgcacgaatctgacggttgatttcacagcggtctgctatcatgcctttcttttccatattctgggcaatgtagccttcatggatagttggctgttcggtgattccctgatctgcaaagctgcggtgatcaatggtagcatttatctgattacgtgcaagcattttatttacagcatctgcccagtttgcccgccagatgcaaagttgttcatcactgttccattgttcggaaataggattctgtctgccatatcggctgctcttggggtgtttatcaatccgttcatatcctttttcctgtgcggcagaggaagtcagatattctttctttttcccaactttatagccatattgcttttcccatccctgtttctgagcagttttaaattcagaagcagtaaatcctttttcttctccatctttgatacagagatattctttttctgttttatactgccatgttccattttcatttagtggtcggacagtaagaagaatgtgtgcatggggattgtgaccatctgtatcgtgaatggcaaaatcagcacacatccccatatctacaaaattctttttaataaaatcctgaagaagagaaatattgctgtctttatccaactcaacagggagtgcgacaacaaattctcttgccagtcggctgtctttggtcttttcggtttcttccacagcgttccagagttgttcccggtcaatccatttggatggagcaattggaggaagcatcacttcctgatagatcagcccatgctttctggtatagtcatgctggataccatcataatcattgtacatccggctgcagctcatataagcagaagctgcgacagcggaacgtccggaaccacggctgacaactttggcttgcatatgataaattgccatatctggcacctcctttcgatgttgcctgcaacagcggaaaagccctcggcagagcgcacgagccccgtaggggataccaccgcccgatttatcgggtggtgagtaagtgcgcccttcgggagtagaacttgtgcgtttacattcctcgtagccggattatcagctcccgtttcagggaatccaaatccatttctttaatatggggaacaatactttccaaaatggctccttcctggactaatcggtgtgttctggcatcacgttcttttttgcgatttcttgcttcggcttcttcttggcggtgtcttgcctgtaaaagtgctttttcttctggtgtcatgatttttttatctgccatatctggcacctcctttttatgcccgtatccgggcagtattggttttaaaatcttatggtttggtactatagtttcggataactgacagtggcatgtttctggtgataaataaggaaagaaagtagtaccactgtcagtgaagaataattatcgtgttatgcttctttgcttcagttcttgttcggagcatgattgtttaacagaattctttttgcctgttttaaattagctgttgcattgtcctgacgaatattccggttattgatacggacaggaatacatctctccagaatacggtcataaattcgtttgtgtgcgatatcagcggcgttattcagctctgataaagtgagattggtcgttatgatcaggggctttttactgcggtaacgactgtcgatcacattgaatacctgttccagtgcaaagtcagagttccgctcaattccgagatcatcaataatcagaagactgtagcggtttaagctgttgatgaactggtttctgtcttcaaaatgcattccggtaagggtatttagaattcgggaaaagttggtcatcagtacaggaacgcctttttccagaagggcattggcaatgcagcctgcaaaaaaagattttccagtaccgacatcaccccagatgagaagtccggaagcatttgctctcatctcttcccagttgcttacataattgtgtgccagttttatttccggattgatgccgttatccctggcaaaagtgtagtcatagagtgctttgtcctgtaagccgctggttttaagatgctctatttccatttgtttttcatgaagttttctctgggcttcttcctgctcaaagatttcctgctggcatttacagcggatggaaggaataagaacctttccctgtaattcatgcctgcattgccttggcgtattgcatttggaacagtagatcaggtggtctgtttcgttaaaatattcatcagactgaagctctctgtttggggttatagctgttggtttttctataaattttgtcataatgtttcgtattcctcactttcgtaatttcgttgtcgggaagcaggatgatcctgtcttgcccaactgatgatggtagctgcgtggttctgatattgctttccggtagaagccatataaccggataagcgttcaatataatccttccagtcagggattgtctgccggatatcttcaagctctttttctgacagaaaaacattttgaaattttccatagggtgagagtggctccttactccctcttattgctaaattgttcttttttatctctttcttattaccagacagttttctgtctgtatcagggaaagaatcctgtctgtcaataggacagttttttgtctgtcttagggaaagaaatctgtctgtatagtggatggtttcttttgggagttttacataaatccgattgggctgtccgggaccctgccgttttcggaagataagctcctgtttttccagtactgccagagcagttttaaccgtcatctggcttttgtggagaacttctgccagtgcttcaatcgtaaagtaaatgaacacatgaccgtctgtatctgaccacccctcatttttctgggaaagccttgcccggtcgagcaggataatataaagcattttggcagtttcgtttatttccatgtccagaaggaaacggggaaacatcatataagatggcaggttggtgtctgctgtcagaaagtcagtcatgtgctcacctccaatcaaaagggtttattccccaagaaaatcccagtctacatcactatctggctgtgaattttcaggtgctggaaaggatgccctgatttggggctccctttgcgccatgcctgcagtcagtccggaaagaaaaagtggcaatgcctgtttcagactgttttccactgcatctacaatctgtttcacaaaaagttcttcccgttctcttgtttccagataaggatcagcctgtgtgcggtagtagcggtcaaaataatctaccagtgcaagagagattacctgactgtaagatttaaaatcctgcctgtccatcgtctgtaaatattcccaggctctccgttgctgttctttgtccagattaaagcgcaggtttgtgttgcggatattgttctgcatggtttatcccctccttttcaggctcatataagccagagattcgtaacctttggcggtggcgcagatgtcatcaatgatggtgactcgtaatttgtcatacgttccgaagttacggatcagacatccaccgccgccaactacatacaggcgcattaggtcaggattgtattcatatttgcggagtgtggaaaaaagttctgccacatactgtctggcaatagaactgatacaatccatatatggtgctgaaatgtcagctgttccaaaccgcagaatctgttctactgtagattcttcaatcttcactccaaatttgtccagaacagcgttctttgcagcaatcatgcattggtttacaccaagtttttctgtccagcatcggctttcttgtgctttcttattgttgatatacagaatgttcatggttccgtttccgatatctgcaaggagattagttcccttgaaatttccaaggtggtttacaatagccggatatccctgtgggtaaaggttacatcccacaaagcggagatgatattctttgccgttgaaacggtaatggacttctggattctggagcagataggaacgaaaagcttctctttgatttctgatccatgtcagaggaagtccggcagccagatgaacatctgcttcacggatggaaaagacattcagttcccttgcaatagccattagcgtcagaagataatattcttcgtccatagctttatccgggataaattctttgtgtccttcgccgatccggtagtaaatgccgttgtattccagaatattcccggtgaagattggttcagtttcataggctttgatgccggttggggtgacggtgtttgctgttttcatattgccgtagccatgatctacagcaatgattttggtgtttctgagttctcgcataaaaaatacctccgttttcgtattgattgattcagcaggtcgtaccggtgtggtactgctctgctgtgggataagcatacgaaaatcggaggaaaaaggcattgaggggaaattgagcaggaattgagaaaaaagatatattgtgcttacgttcttcatgtactcttgttgtgatttcattgttttttatcgtataatatggatactggaggtggtttggatgaaatacaagattttagttgtcgatgatgataaagaattggtgaaaatgctttgtagttattttaatatgaaacaatatgaaaccattacggctacagatggaatggaagcattaaataaaataaaaatgaaaccggatattattttgttggatatcaatatgccacgcatggatgggattgaagtatgtcgtctgatacgcagtaaagtgttatgtccaattttatttctgacagcaagagttgacgaagatgataaaattaatgggttgctttcaggtggggatgattatattacgaaaccatttagtcttcgggagttggaagcaaggattgtcacaaacataaagagagaagaaaggcatcaacaaaaaacggaataccgtttcatggatgaaatgctgattgattattctgaaaaaatagtagctatagctggacacaggatggagttcacaaaaattgaatatcagattattgaattcttatccatgcatccagggcaggtgtttgataaagaacgtatatatgcacaagtctgtggatatgatgcggaaggggacagtagaacgataacggaattagtacggcgtataaggaaaaaaatagcggattattcagaaaaagaatacatagaaactgtctgggggattggataccgatggaaaaaataagaaacttgtcactgaaaaaaacaattctgctttattttgtgatcagcttaacggcagcatttctgttatctggatttacagttcattttgcaggaaatatgcagaataaaatatgggaaaaatatattgattatgcagattatacggacgtgtttcagcaatatggaaagaaatacgagattgagatatcaagacctaatcaatcgcagatgaatcgtttggactatcatctttcggaaatgtgtgactttatggaaacatattcggtactgattttttcgattgttgggagtgttgttgcggtattctttttttataaaaataagttaaagacacctctacaggaactaaaagatgcctcacaaatgattgcagataatgaactggattttcatgtgtcctatgaaaataaagatgagatgggaactttgtgtaaagaatttgaaatgatgcgaagtgatttagcagataacaacagaaagatgtggcgaatgattgatgacgagaaggctttgcggaatgcaattgcacatgatatacgttctccactttccatattgcgtgggtatcaggaaatgctcttagagtttgtttctgccgagagtataaaaacagaggatgttattgatatcttacaaacaggcatgtatcagattgaccgtatagagcatttcacggaaaacatgagaaaaatgtcccatttagaacagagggaactgcaatgctcagagatagagttatcggaactggcaaaaaagattgaggcagaagctgccatgctgtccaagaaggaaagtaaattatgtaaggtagaaagagtgcaggaacaaaacattgtgaaagtggatgaggaacttgtcatggaagtgacagacaacttactggaaaatgcggttcgatatgcacaaaaaagtattgctttgcagataaagaaaaaggatggttttcttataatttctgttgaagatgatggaataggatttgtggatactgaggaaaaagtaacagagccattttatcataagaatccacaagatgatttaaagcattttggccttggtatgtatatttctcgtattttctgtgaaaagcatggaggaaatttgaaaatatataatgccagacaaggcggtgctcatgtagaagctcttttcaaagctgaataaaaatactttataaggctgaaatcgcaaataaagtggttttagtcttttttgttgtgaatttattgagaattgatttgtatgatgttgttaaagaaataaagaaaggaagagatacaatgaaaacaatcataaaaagaagtatacttgattatttcaagaaccctgttttgtggattggcttgattattatagttgccagtatgtatcaatgtctgtcatcgtatttgcaaattcattatatcaaacagaatgaacagatcacacaaaatgacgtagcattggaagatgctgatgtcatggatgggtacattcccacatctgatgataaagaaagaagaagggagtgggaagatacgatcaaagagacgttaatggacacctccaaaaatggttttggatttagcaggcaggaagcagatcatgtaatgaaagaaattcagaatatggatgtaaagactgcttctgagtttttggaatcccaatatggctattataatgcaatatatgcttatgaggaccttgaaattcataaggggacagcagaagaaatcaatcattatatcgagcggaaattatccgaacattctttttcctggtactttgccaaaaaatttacggattttgcaggattgcatatggccttttttgcaacagtcttgctatcatttttatttattcaggatacacgaaaaagtacctatgaattattacatacaaagcctgttacggcagtccaatatatatgtgggaaagtaataagtggattcattagtatgctgggagtattagtgattttgaatgttatattctttatgctgtgtttgaaaacgtctttagaatcgggctttccagtaacaccaattgatttttgcgtgaattctctgatctatattattccgaatcttttgatgatatgttgtgtctatacaattacagcagtaatatttaaaaatccgcttccggcagcaccaatcttgtttttacacattatatattcaaatatgctgaccatgaagaatgatatttattatatgagaccgttctctattatggtgcgattccctggcagattttttgaaacacatgtagccaaaatgtcaaacataaatcagattattcttgtaatttcatcagttatattagtatgtatttctgttacaatctggaaaaggaggagggttcattgaaaacggaactaaaaaactgcctgtcgttatataagattttttattcatgtgcatttatactgatattgtgtgctattcatccgattatatactatgaagaaatcggttcagcgattcagtcgccaatagcatttttaacaattattttttgtagtgacacatatttgatggaagtaaaaagtaagcgtgccgatgtatttcatttgtatgatcaaaaaaagcagttaaaagtaatatcgcagagagtgggcgttcaaatattatatttattaatactttcctgtgttggatatgttttgtttttctggcaaaaaccgggcagtgtaaacgaaggcatttcgggtattcagatatttcttttatatttcattgcaatgtttggaactatctggctttggagtatatgctctgtgattttgtgtacattgcttcgaaatatgtgggcaggtattggatgtttatttggaattgtcattggacttatatcaaaagcgggaagttcatttttcggaaatctgggattgttttctttcagcttttgtgaacctactcaattaatgtccgagagttggatttatggaacgcttgtgtcttttatagcggggctgtttttatttgcagtattaccaatgactttaaagaaaagaggatagattatgagtattagaataaatgatttaacagttagatttaaaaatggtgtagttgcagtaaataaggcatctcttgaaatacctaagggaatttacggacttttgggtgagaatggtgccggaaaaaccactttgatgagggttcttacaactgttttaaaacaaacggaaggaatggtttcccttgatggaattctgtataacgagggaaattatgagaaaatacagaaaaagattggttatcttccacaggaaatcgacttatatccgaatcttacggtgaaagaatgtcttgtatatatgggggactgtcaggagtagccagaaatgacctcgaacaaagaattacctattatctggaaaagacttctcttacagagcatcagaataaaaaaatgcggcaattatctggtggtatgaagagacgtgtcggactcatacaggcacttcttaataatccggattttttgattattgatgaacctaccaccgggttagatccggaagaaagaatcaggatccgcaatcttttggttgatttttcaaaggatagaactgtgctgttttccactcatgtagtagaagatttagcagcaacctgtacacagcttgccattatgaaaaagggaagttttttatattctggaagcgtgagtgggttgctggaaaatgcaaagggctgtgtttggaattgtacggtacaaaatgcagaagaagcccgtttgttagaagccaattattctatatcatctaagcagtatgtagaaaatggaattcatatgaaagtattaagcaaaggaaagccaaatgagaattgtgtcctggataatgatatcactttggaagatgcatatatttatttgacgaatagttgaatataacggcgggcaagttgcccgccgtaaattatgcttattttgttaaaagaccggatagattttttccaatgcaaaatccaatctgtggatataactcctgaatttcctgatattttgcttcaatcatttctggttcatcagcccagatcttttcatatattttgaaagctcttttaaaatgtgttttggcttgcggaagattggcagtcatcagataaatggttccaagggtttcctgtactttggcataatccagacagtcatcggaatggtattccttgatgatgccggataatttttgcaattcagagatgcctctttcgggttcctgctgttctgtcaggaacattgcataattggcaatctgaggtatgctgtcatttatatgaagcaggttaaattggtcaagcagtgagatacttttttccatgtgttctcttgcaagatcgggatgaccgttcatgcggtaaagtccaccgagattggcatgaaggttggaaacaaggcgagcattgtcagcagtgatattttctatctgggcaagtgcatccttttccagttttattgctttttctggcttgatttcaagagtagcctgaaaatccagtaacaatgcccggtcagaatcggtgccaatgtctttaggcttcaaaaaattttttaattcctgaatgatttctttcatacctttctggtaattataattatccatatatggaaaaacattttccagaaaaagtagatattttggtatatcatctttttcaatcaattctatgatgtttcctgctgtctgaaacagcttcttgtaataatcgacttcaattccatgcattaaacatattttctgtaaagaatccagtaatatgtgacagctacttacagatggttttgtctctgaaagggcaatttccttaatcataggatgcagggagattgtgtgacgtgtagttgtctgcacaaaaccagtttcaatcaagtcgttaatttcatttaaggtaggcagttccagccatttggcgaatatgcgggcagaaataccagtgtaaggaagaaaacacaaattgcacatgatatcctgctgttttcgggataaagcatatagtgaaaatagagtatggatatgactataataagtggctttactgctttgaccatccttgattatcttaattttatcttcattatcgagagatgctctttcttcctgaagttttgctaataactgacctggagttgaaattccattttccaaaagttttgcagccagttctacagcaaaagtatgatagtgtacggtctctatgattttttcgacggtcgaacgatacttgtctgcttctgaataaaatgcagatgtcagttggaaaagaatgtttatatcctttatttcttttaattgaaaagtacagtattcattcagattacttctggtcgtaaataaaatctgacagcggtattttaatactactgacagaaaactgtcctgtgtagctgtgacattaaaattatctatgataagcagagtatcggatttcagggaacgcagaaaacggttatgtctttgaaaccgttcctgttcgctgatttctggtggatcatcaataaaatccatgtcagtaatgtcctgatgaagatcacctgtatattctacatatagaatgttagtgtaatgctttttgtaatgttttgcgtaggctttggcaagttcgcttttaccaataccggcaattccgcaaagaaaaacatgacggttttcctcaagcatggtatataattcttctagttctttatctcttccgataaaatgacggcatggtttcggaacctcactgtccataatataatccagcacaatgggtgacagggcacctccggcaattaatttttgatttttagtatcacgtttgataaattgtcgctccatgccaaaagaaatcagctttgcaagaaaaagcagacgtgagctggctggtttgtacagagaagccagatttttctttttggcatcggagatggtgtcatcttgtataaataatgtgtatatatcctgcatagccatattgcagtcagacatcaatggaagcagattctggtgaatggtttctgccagttttttctgattactgggtttggaatagtaggcagatattttgggactgatctttgcttgaccggtcagccaacgacaaaccagaccattatccatagaaaaatcctgatttgccggatcatccataaaatcttcaaataattcgtataaaaaatcaggctgactcatttgattactttcgctgatatgattttttaagcaagtgctaatagaagaaaaatcgcatcgattcaatagaaattcccctttcgtagttaagattaagtatatctatcataacacgaacatatattcgattcaagaaaatgcggatatttttaaattgattgtgtcaatttacaatcaatttctattcaatgtggttttccggcaggttctgtaaaataagctcagatcaaaacaataacgggaggagcttatgcaacagaatattgaatttgagcggtgcattgattttctggtacggatgattgataagtacggcgctgaagtcctccgggagttggaggaagaaaaacagaataaggaagaaaaagaagcggcagtttcctgaaatacaaaatgtaaatcagactgtcgcttttttcatgcatttttaaatcaaataaattttaaaagctgatgcagagtgtgtggctcattattctgagaagcggtaatacgcgtatcaaatggcttgaaatgattctgcgtataaaagctcagaagaaattcattatcttcgcattcaagaaactccataacgccacctacggaatatttgagactggatatggtttccagtgcaaatcccagtagaatatttccaggaattcgtttttcctttggaagagaatagttctttcccaactgggcgatcaagtaagctgcggtagtataggattgtgtttcttcatccaaaatactgacacgggacagtttttttgccattgtcttgctgatatttgaagcacggacagagattggttttattgtaagtgaaaaataaccaaccagtgaagcatcttcagcatcaaataccagataagtgatagattgatcttttttggtaaactcaatcgcattatgtaataaaaagtattccacatcgggatttttgggacaagaaaaatcggagagtaagtcgtaaagactttcctctccgatatatgtcggttcgtctttatccaaatatgcccgaatattaacggtaaaatatttatcagacatgttttttcttcctttttgacattaaagctaagatttcctgtgggttcgttaactgacgtccgggaagtgtctgctttggtgtgcggtcacggtcggcttcgtcaattgctgcgacaaaacgctttacgctatttggattggatacgacaaaattatgagtaatacttgaagtagccatactaacacctcctcttttttggcttttttgtgtatttatagtatatgcaatgtgtgataaaaacacaatatcaaaaacagaaattatttctaaataattttcaagccggacatttattagacgcttccggtaagcgaacaatattttcgagccaatcatttataagtcgccaatggtgggcgggcaatattttgataacagaaatgctctgtatctaacttaattatacgattggcgaagaaatgcgtcaatacggaaaataagtattgaaaatagttggaacaagtactaaaataaggttgggacaataaaacagagttatactgcgaggaagattatgaagaataaaaagattaaatgcgatatatataccagagtatccacaaccatgcaggtagatggctacagtctggatgctcagaaagaaaaactcaagagatatgcggaatttcagaatatggaaatcgtaaatgagtattcagatgaaggtaagtctggaaagagcgtagagggcagaccggaatttcagagaatgttggataatattgagaatggaacagatgaggtacagtttgtactggtgttcaagctttccagattcggtcgtaatgcagcagatgtattaaactctctgcagaggatgcaggattttggagtgaatctgatctgtgtagaagatggaattgacagctcaaaagatagtggaaagctgatgatttctgttctgtctgcggtggcagagatcgaacgagagaatatccttgttcagacaatggaaggacgtaagcagaaagccagggaaggaaaatggaatggtggatttgctccgtatggttatgaattagtaaatggagaattgcagattgcagaggacgaagcagagattattcgtctgatctatgacaaatttattcataccaatatgggaatctctgcgattgccgcatggctgaaccagcatggatataaaaagaaaaaacgacagaataatacactggacgcatttgccgcatcatttataaaaggcgttctggataatccggtatactgtggaaagctggcttatggacgaaggaaaaacgagaaagtttctggtacaagaaatgaataccgcattgtaaagcaggaaaattatatgctgcacgatggtatccatgaagggattgtttcagaaacagactgggagctggcacatcaaaaacgggaaaaaacaggtgtgaaatatgaaaagacacatagtctcgatcatgagcatattttatctggaatattgagatgcccgttatgtggaagtggtatgtatggaaacgtgaaccgaaagaaaaagaaagacggaactttatataaggattatttctattatgcctgcaaacatcgtcgcctggtagatggtcataaatgtggatatcgtaaacaatggagtgaggagaagattaacaatgcagtggaagaagttattcggaagctggtgaagaatcctaaatttgaagaagcaattctgaataaaatcggttcaagaattgatacagaagaaatagaaaaagagattgaaggattggaaaagcagcacaggcagctgaccggagcaaaagcaagacttggacagcagatggacaatctggatatcatggataaattttatgagaagaaatatcaggatatggagacaaggttataccgtttgtatgatgagattgaaggcgtggagaacagtatagaagaagtcaagaaccgcctgctgaatatccggcaacagaaaatatcagaagaaaacgtctatcaattccttttatattttgataaactatatgataagttcaccgacctggagaagaaagaatttcttaacagctttgtagaacaggtggatatttatgagcaggagcagccggatggcagattcctgaagcacataaagttccgttttccggtgtattttggagacagggaaacacaggaactttgttgggacaacgaaagtaccgttgagactgtggtgttgctacaaaggaagaatatgtagaaatccttgaatttacgcactttgtagagtttttcagtttcagaaaaataggtgaaaatcacaaagaaaagagccttgtgaagaaagtaaccgttgttgttgcgttagaccttgggacggggaacacaaagaatacagaatcacgcgccaagtctcacggacgttcgacttgaatactgggaatacagaagttacgcttacaaatcgagaatttgaaatactttatctgttagcaagcagtccgggaagggtgtttagtaaggagcaaatttatgatcttgtttgggaagaaccctatttcggtgattataacatcgtcatgagccatatccggaatattcgggagaagataggggataatccaagtaagccaatctacatacagacggtatggggtgtaggttatcgtttcaacaaaaatataagcagtggtctgtgagtagattacagatcactgcttatttttcatttttaacacccaagagatattcacaagatacatgaaaaaattcggcagagccactacctcataatccggtacaaagcgtgttccttgttcaatacgaagtactgtaagatcactgaattcatatccggcaagttgcagttgctggcagagatttcaggagaacagaggaagcttttcgctgtttgtaagataatttctgccggagattttgatttaatgatttgatttataaaactggcaatgatacaattagcgtaatttgaaagaaagcagagaaaatatgagtgaaaagttactgattgttgaagatgacaaaaaattaaatgatggaatacgtctcgcattgaagaatgattcctatttcttttatcagtgccagactttgcagaaggctagagaaatcttgaaaaaggaagatatcacattggttttattagatgtgaacttgccggatgggaatgggattgattttgtaagagaaataaggaaaaacagtcaggtgccgattattctgcttacagtaaataacatggaagtagatattgtaacaggattggaagctggggcaaatgattatattacgaaaccgtttagcttgatggttttgcgtgcaagagtgtctgtgcagcttagaaataaagaggcagcagctaaaaattctatggagcttgatggatttgagttctatttcgataaaatggaatttttcaaagatggagaacctattgaacttagtaagacagaacaaaaactcttgaaagtgctgtgcgaaaacagaggaaaagtagtgaagcgggaatacctgattgacgaggtatggcaaggagagacagagtttgtggatgctcatgcgctgactgttgcagtcaaacgtctcagagacaaattagaagatgatacgcagaagcctgaatatatcaagacagtctatggaattggttatacctgggcggtgaatggatgatagaaataattatattgattgtaggaatatttgttttaagtggaatcttatggcatagtattttttatcagaaagaaaaaaagcttttgaaccggctgcagcaaatgctggattgtgccatagatggagaactggaacggacagaaatatcagaagaaaagtattctgctcttgaaaacagcatgaaacaacatttagacagtagctttctggcacgaaagaaccaacaggaacaaaaagaagtgatacagaaacttatttctgacattgcgcatcagactttgactcctatttcaaatttgaaaatttatggtgaaatactctctgaaacgaatcatgaaaatcaggaggagatagctaccattttggagcaaacagacaaattagattttttgatacaatcattggtcaaattatcacggatggagagtggaattatcgcagtacattcggaggatactactattaagcagatgcttgaatctatacagcagcagtttaacgtaaaagtaagggagaagaatattactctgagcctatgtgacacggatttgcatgctatgtgtgattcaaaatggaccgtggaggcactcggaaatattgtagacaatgcgattaaatacacagcatgtgggggaaatgttcagataaaagtcgagcagtattctttttttgtaaagattgatatcattgatgatggcattggaatagaaaaagaagaaataccaaagatatttggaaggttttatcggagtctgtcagtggcagaccagccaggagtaggaattggcttattccttgcaagagagattattcaggcacaaaaggggtatataaaagtgacatcaaagagaggaaagggttctacattttctgtgtttcttccgatagcaaagaaggaatagtatcaaaactgtgacatttcagaaactagatggagacattgttatgataaagtctgtattgtaaagatcaatacaggcttttttgatgggaggatgacatgaatatattaaaagcggtaaatttacgaaaaatatatgggcagggagaaacagaagtcagggctcttgatggtataaacctggaagtagaaaaaggggagtttgtagcgattgttggaacctctggaagtggaaagtctacattgcttcatatcattggtggtttggataatccaacatccggtcaggtcattgttgacggacagaatttaagccatatgacagatgaagagcttactatttttaggcgtagaaatattggatttgtatttcaacagtataatctggttccgatgctgaatgtatgggaaaatattgttcttcctgtaaaactggatggaaaaaagattgaaaaaggttatgtaaatgaaatcatagatacactgggcattcggacaaaactggaaaatcttccaagtgcactgtcagggggtcagcagcaaagggtggcaatcgcaagagcattagcggcaaaacctgctattttgctggcagatgaaccgacaggcaatctggactcaaaaacgagtcaggatgtattgggacttttaaaagtcaccagtaagcgttttcatcaaacgattgtaatgattactcacaatgaggagattgcccagatgactgacaggattttacagattgaagacggaaaaattgtttcagacagtggtttggtatagtgagggcgattatatggtaaaagtagagaataaagaaacgttacgattattgacgaaacgttttatgaaaatgaaccgagcaagaaatattattgctgttattgcaatcatgttgacatcactgttatttacaagcctctttgtggggagtgtatccatgatactttccaaaagagcaacggaaattaagcaatttatggattcatcccatgctattgcgcagaatttgtcagaagaagatgcggtgagattgcaaaaaacaatagaacaaagtgatgaggtggaacgatatggaacaggcatttttctgggagcaggaagagataaacattttggcttttcagtagaagttagatatgcagataaaaatatggcagaaagctttaattgtctgccaactacaggaagactgccagagaaggaaaatgaagtggcagtcagcagcttggtactggaagcactgggagttacaccaaagattggggaagaagtcacgctgacgtgggaagtaaatccaatgctgaaacaatacaaaacagatacattccagatatgtggattttggcagggtgataaggctgttttaggtcagatggtctgggtatctgaagcctatgcgaaggagaattgttatcctgttacacagaaagaattaaaaaatggtatctataatgggggaaaggagtattctgtctggtacaagaatctttggaatctggaaaagaaaacagaaaatatatctaagacagcaggatttacgaaagcaaggacaggattggagatcaatccggcatataatctttttgaagaggattcattttcattcacttcccttattgtaatggtactgtttgtgatattggctggttacttaattatttataatatttttaatatatccgtgaaaacggatattagagcctacggattattgaagaacgtgggaacaacaggaaaacaattgaaaaaaattgtacgtatgcaggcatggaaattgtcagaagtggggattccaatcggattgatcttcggttatcttgcaggtttttgtatgtcgccgtctctgacagcagatgcccaaatcagtgcacaggcaggacagactacacagacagtagtatcagctaatcctttgattttttttgcagcagcacttctgacacttttaacggtgtatttatcctgtctacgggcttgtaaaatggtggaaagagtttcgcctgtggaagccctacatttggcagaaggagagcagtcacagaagaaaataaaaaagaatacgtctgtaacctggtggggaatggcagttcaaaatgtgttccgtaactggaaaaagggattgattgttatgctttctatcgctctttctatggtagtggtcaactgtattgtgatgttggtgcagggatatgattttgagtcttaccagaatatagttttagcatctgattttcaactggatcagatgaccgacactttatcgaatacaaatttcaacggtattacacctgaaatcaaagagattctgaataagtgtccggaaagtgagaaaacaggatatgtgtattattcggaagaaagacataagatggaaccggcacttttgaaaacgtgggagacattggcagaaaaaaacaaagaaaactggacagattatgaaaagcaaatctgggaggaaacaaaagcggataatactgtaaaggttcatttcctcggaattagtgaagcggtgtttgatatgttagaatggaaaggggaaaaatgttcctgggatacgtttaaaagtggggattatgtgattgtggactatagtgataaatatacagaacaaccagtttcttattatcagtctggcgagacttttaaaatggagtacggaaacggaaagcagaaagattatggggtaatcggagaagctatgatgccatattccctggattatccgtatgcagattctgtttatattacagtaatggtcccagaagaagagtatttcacccagacagaaaatcaatcagcaatgtatgctactattgatgccaagaagggagaggataagcaagtaaaagaatacattgataaaaatgttttgaaagaaaatgatatgataaatgtttcttctgtattggatatgaaggcgagctttaggcggtttgtcagtaaatattatatgatcggtagttttcttgtcattattttagcttttattggcattatgaatttctttaatacaacagcaacctctgtaattagtagaaaaaaagaactggcacttttggaagttgtgggaatgacgaaaaagcagatatcgaaaatgttggtggctgagggattcctatatttgggaggcgcatttgtgattgcagtattgctaattatgtttggagcaaagcaaattttagtaaatacgctcggtacagcatttttcttccggctgcatcttacgatagtgccatgtgtgcttatgattccaattttggttgggatcgcgtatgtgataccaaagtatcagtttgaaaagatgagtcgggaaagcattgttgaaaggattcggaaagaataataacaattgtaaattaggcgtatggatttgatgaatctatgcgcctattttttagaaaattacaattctatatcatatgacttattcttagtccgagcaggctgatttcgccgtatttcctgttctctttgatatttaagttcccatgcacgatgggagaagacatcaggatcttccacattgagataatccacctcattggctgcaatatcacgacggtgatagtcataatatttaccgaacatacctttgagttgctttttaactgtgttgtatttattcagtattggattaaaatgattcatccaatcatgaattacttctttttgcatctcattatgaagtaaatggtattgtgtaaaaatcatatgatttcggatagtttccattgtttctgcaattacaggaatagaatttttgacagcctgagccagtttcgatacctgagtttttaattcccggagcatttggttatctgcacgaatctggcggttgatttcacagtggtcagctatcattcctttcttttccatattctgggcaatatagccttcgtggatggtcggctgttcggcgattctctgatctgcaaagctgcggtgatcaatggttagacaaaaatgcatataaatataggtttgtaaaacattacccggaagataaaatggatataacaggaattagtaatgaaccatggcattaccgttatgttggaacgactgtcgctaaaataatgaaagaagaaaatttatgtttggaagaatatttagaaaaatataaataaaaacaaaagaaaatcctaactttttttatagtaggattgttatattatttagaaaacagagggaggcaaatttgcgaatggaatacaaaactgattctttgttagtacatctagcaagagcaggagatgaagatgcgtgtgaaaaactggtcaaaaaatattactcaagtatatatcaatattgtttgctacatatcaatgatccatatgaggcagaggatttgacacaagaagtgtttacacgtttcttttccaatttatatagatataaagaatatggaaaagttaagaattatctttatacaattgccggaaataccgttaaaaattattacaaaaagaaaaaagatattccatcagaggaactgctaaaatcagaggactgtagtaaaaatcatgtagaagagctaggagttcgattaactattgaacaggcagtgagaaagttaccggaagaaattagagaaacggcagttttatatttttttcaggaattgaagcaaagagaaattgcagaattacttcatatcaaactttctcttgtaaaatatcgaatcggaagagcaaaagaacttttaatgaaagagttggaggtgaaaaaagatgaagaattataagcaacaaataaaggaatataaagaggagattgaagaaaagtatgtaagggctgaaacagagaacaaaacagtaaaagcatgtcagaatattttgtcagagtcggttttatcgaaacaatcgcatagaacatcttattttgaatttttgtatgagcagacaaaattcataaaaaaaagatggtggattttacaaggttgtgttcttatgtgtctatggatatggttgagtaattatacgtcagacataaaagatatgatgaggattatgggaatatctgccacaatatttgtggttctgattatcccggaaatttggaaaaacagaagaaatggtgcaattgagattgagcaggcgtcttattacacactgcgtcagatttgtacagcaagaatgttaatgtttggagtagtggatctggtgatcgttatggtgtttttggcaattacatatcaaacaacaatactctcgttaagtgatttggtggttaattttctgcttccagtaaatgtttcatgttgtatatgttttcgtgtattgtacagcagatgggaaaaatcagaatatatagcagtgctttcctgtctggtatgggttggtttatggatgatgattgttgcaaatgatgttatttatcagaaaattgtaactccggtatgggtggctatgctgatattgacttttgtatattttgttttttgtgttcagaagtcattggtatttgatgaaaaaattttggaggattacacgtatgaaattagaatttaaaaatgtaacaaaacaatacggagaagtaaatgctgttaataaagtgaattgtgttatggaaaaaggaatttatggactgcttggagtaaatggggcaggaaagaccacattaatgcgtatgctttgtacgattgttcaaccatcagaaggacaaatattatggaatggtaaagatatatggaaactaggaggtgaataccgagaagttctgggatatttaccacaggattttggatattatccagatttgaccgtatatgattatatgatgtacatttcttctataaaagggttaaaaattgcgtttgccagaaaaaaagtgaagcaattattaaatcaagtaggaatggaaaaattcagtaaaagaaaaatgaagaatttgtctggaggaatggttagacgtgtaggaatagcacaggcgatgttaaacgatccgcaaattcttgtcctggacgaacctaccgctggattagacccgaatgaaagaatacgttttcgtaatttaattagtgaattgtcggaagaacgtttggtgctcttgtctacacatattgtatcggatattgagtacattgcgaataacattatgttaatgaaagatggagaacttttttatgcaggtactgcggaagatttagtatcttctatgaaagaaaaggtatggcaatgtaatgtttcgagaagtatgatagacaaatatatgaatgaatatttggttggaaatataaaaacaacaaaaaccggagcagagcttagaattatttcaatagaaaagccaacagaagatgctgtggctgtagaaaaaaacctggaagatgcatttctattttattttggagaaaaatcggaggaaaaacaagatgcttaaattagaattaaaacgaattttttcaaagaaaattaatgtatttgcaatcggattggcattgatacttgctgtcatttttagcggatttgcagttacaagtaatcgctatgtggatgagaatggaaatgctagtactggaattatggcaacaagaaaacttacagataacagacgagcatggaaaggtacattgacagaagatgaacttggaaaagttatagaacaaaataaaaatgcgatgacacaatcctcagaagaaaatgcgatttatggaacgacattacaaccgatagatgatattaggggttttataatatcggtattaacaccggatgcagaatatgatgaaagtgttctaaatcaaattacagaagaaaatatacaagagttctatgacacttatcataaaaatatggaaaagatggcagaagaatatggaaagacttctgttcagaaaaaatacttggaaaagaaatataatgaaataaaattaccagtagaatacgaatcttatagttcatgggatactatgattatgcatgtagaaacgtattctattattctggcaatcatagttggttttatttgtgctggaatattcgcagatgattttcagacaaaagcagatgcagtatttttctctacaaagtatggacgtacaaaagctgttaaaacaaaaatactggcaggaatagctacgacagttatgatttattgtatgggaattatattacttagtgtgatttgttttggaattatgggaaccagtggtatgaatacaccttatcaaatgtatcaggcgtatagtatttacattatgtcatatggacaatactatttgttgacagttgtatgtggatttatagccagtatgctggcggctgtagtgtctatgttagtagcggctaaaatgcatacaattagtgtcgctgtttgcattccgttctttttatattgcttattgccatttataggacgggcactttctgggtatacaacgcttttcaatttgataccaacaattttgacaaatgtacaggcaagtgtaaaagtcccacttatttatcagattgggaattgtgtatttcgacaaattccgcttgtaatggtaatgtatacagtgatggcaatagccttactgccttttatttataagagttttcgcagatacggaaataagtaaaaattgagtatatctatcatagtacgaacatacatttggttcaagaaaatgaggatatttttaaagtgattgtgtcaatttacaatcaatttctattcaatgtggttttccggcaggttctgtaaaataagctcagatcaaaacaataacgggaggagcttatgcaacagaatattgaatttgagcggtgtattgattttctggtacgaatgattgataagtacggcgaagaagtcctccgggagttggaggaagaaaaagaagcggcagtttcctgaaatacaaaatgtaaatcagactgtcgcttttttcatgcatttttaaatcaaataaattttaaaagctgataaaaaagaatgataatttggagaaaagtagcatagaataattttgagctgatatgacagagaatgttttggcgtattgacaggacatttgaaatgacgtatactaagctcagtgatcgttctgtagaaacttgcgaagcctacaggcgggggagagcctgcgggtctctccctcttttgttttaaggagaaatgagatgcagacaccgaaaaagttctcttcttttagtgaccaggtttcctggatcagtgatgaaaagggaataagaataaaagacagagaatatgcggaagagatgttacgccaaataggatattttcctcttatgggaggatataaacatctttttagaatatcgaatacaaagaaatataaagcaggaacaagttttgaagaaatagtcagtctgtataagtttgatgcagagcttagagagttgttctttaaatatttactgcagattgagcgacagatgcgttctttgatgtcatactattttactgaaatgtatggagcagagcagaagcagtacctggatgctaataattataataatacaaaaagaaatcatgcaacaatcgtaaaattgatagcgaccttgaaacgggcaacaacgaccacagattatacatatatcaactattaccgcaagacatatggtgaaattccattatgggttttggcaaatgtacttacgtttggaaacttatcaaaaatgttccgagtgtttccgcagtccttaaaatcaaaagtatcaaaaaactttgaacctttgaatcagcatcagatggaacagtttctatctgttctcactaagtataggaatgtatgtgcccatggggaacgactgtttacatacagaacggtagatgctattgcggatacaccgcttcataaaaaactttcattaccacagagcggtaatcagtatgaaaaaggaaaacaggatctgtttgctgtgatgattgcttttagatatctattacctggaaaagattttctggaatttaaaagaaagcttataaaagagattgaccgagtaaacagagaagtagagcatataagtgaagttgaattattgaataaaatgggcttcccggaaaaatggaaaagtattaccaaataccatttaaaagaaatatcctctaagagatagtgaaacacctattgtcttagaggattttttgtattaattataggattgacaaagaaatgagtcaataagaaaataaatctcgttttctacatatatattcaccacttagatttctctcaatacccatctgtgaatgaagtcgggtgttacaaagtggacgaagagagaaagatgcatgacgaggaaatggattataaaaaactgattattatttgatagaaaagattgttaatcaggatcagcttaaacgtatatacagatttgttaagtatggaaaactgaaataattactttcttccaaaagtgggaaaaagaaattttacggcgggcaattatgtccgccgtaaaattatgtctgttttgttaaaaggtttgatagctgttgcccaagaaagaaaccaacttgtggatataactcctgaatttcctgatattttgctttaatcatttctggttcctgctgttctgtcaggaacattgcataattggaaatctaaggtatgctgtcatttatatgaagcaggttaaattggtcaagcagtgagatgctttttgtctttaacagacatttcaattcctgaatgattcccttcatacctttgtgatagttatagttatccatgtctgctcaagtatatgccttgcgtaaaaaggcgacatgattttcatgccggatgctttgaatttggtagtgagaatgtactgctcatcatcgctgagataaaattgtaccggattggtgcggtttctgtttgccattgagtcacgtccttcctaaaaatgggtaaaaaaaactgctgtaaaatgttcggtttttacaacagtctgtttcgtgtttgattcaattttgggtgtaactacccaaggcaaattgtagcaaagatggtaggaaagtgtgggggatttcgcctgtgtcatgacacaggcagtgcttgctattcttgattagttaaaggtttttaatttccctgattttaaaataataccgatcaataatatcctgcaatgtaatggatttcattttttcatttaccatattttgaatttcatgatagaagtccccaatagcgaattgaatgttgataccgattccacaatccggattggtatctgtgtctaggtgaagcagcggcttatcgccctctacggctcggtagatgtcatacatattgattttatctgccgattttgcaagagcggcattcgcatgaccttgtgtgttgacaacaatgcctgcatttttcagggttgccataagctgtctgacataagccgggtttgtcttgatactttctgcaatttttgtgctggagagttgttcgtcatctccaagagcaataaatataagaatatgaatggtgtcactaagctttgtggaatatttcatttgtcacctcgaattttcttcttgcaatttttaaatttacatgataatatgattttaatgcttgatgtaaatttaattttaacaagtaaaaaaataaaagtcaagcgaaataaaaagtgtggaatctgatataaaaagggagagaaagtggtgtatgcaaattcctttttgggaaatgacatacaaaaatgaaaaggtgttttatgcctgtctgaatcagaagaaatcctcagctccagaacatataaaagacaaaggcatttatatagcaggagatttggcaaaaaccctgcgggatttaaaagaaaacatagcaggaaaggaaatgtgatgaagatgaatgtatatcaagagataagtcaaatcatcaaagaagcagatggtattttgattggagccagtaatggtttgtctatcgcagagggatataatatttttgcagatgacgcatggtttcaggaaaatatgggagatttcagagaaaaatacggattgcgttgtgttttacacggattttcagtgccaatgaaggtagaagaaaagtgggcgtttgtaagcaggcttgttaaggcaaaagctatgcaggatgagccgagtgagattatgaaaaacatctatgcaatagtaaaggataaagaatatttcgtagtaacttccaatgcagaggatcattttgtgccggcaggttttgaggcagaccgtgtttttgaaatggaagggaaattaacccagatgcggtgcaagaacagatgtcatgacgaggtctatcctaatcaaaaagcagttctcgccatgacagaagaggaagtaaacggaagagtacccaaagagttactgccgaaatgtccaaaatgcggtggagatatggaagtaaattggggtgagatgtcctcgtttacagaaacgaaaaattggaaggaaaaggctgcccgctatcaagaatttattcagaatttacatggaaagaagctggtaattctggaatttggcattggttggagaaatcagatgattaaagctcctttgatgcagcttgcagcagtagaaccacaggcaagttatatcacatttaacaagggcgaaatttacatcccagaggaaatcaaagaaaaatccatcggtgtggatggtaatcttacggtagcgttaaaggaaatcagaaagggaaggatagactaagtaaagtggttaaagatattacagttgtgagataggagaatgaaaaaaatgagctgttatgaaaatttggtaatgaaaacacaaatgaactattccagacactatagtacctatgcatccggtggtactgctgtagtgttgagcaaacaaaaaccgctttcttatgaggaacagattcaggaatttgttcgcagagtgcaggaggcagagtgtatcgtagtaggcggagcatccggtttatcagcggctggaggtggtgacttttattatagtgataccccttcttttcgtgagcattttggaaaatttgcagataagtatggattcaaaggtgcttttagcggcatgatgcatcggttttctacaagaaatgaacactggggatatgtggcaacctttttaaatactacacaaaatgcccctatcagagagccatatctggatttggatagaatcttgcaaggaaaggactttcatatcttaacgactaatcaggatacacagtttgtaaagatttatccggaagaaaaggtcagtgagattcagggagatcatcgtttctttcagtgttcccagtgctgtcaggatgaaacatgggatgccgtacaacctgtggcagatatgattgcggctatgggagcggggacaatggtgccggatgaactgattcctcgctgtccttattgtggtgcggaaatgtttccttgggtaagaggatatgggaattttctgcaagggaaaaaatacgaagaagaatatgagaaaatctcaaaatacattcaaaagaacaaagatagaaaaattctcttgatagaacttggagtaggacgcatgacaccgatgtttatacaggaaccgttttgggaactgacaaacagcttgaaagatgcatattatatctccgtaaattcagaatatcagtttttgccggaattcattgaagataaggggattgctattttggaagatataggaacagtgttaaaagatttgcggaaagcaaaagaggaaagtgcatttgtataggatacttgttcttgatattccacttaatggagaaacattagaatattgattgatacaaaactgcactcagggatattgtgggtgcagttttgcattaaaattattgattacgatacagtttctgatatccagtaatgtgtggcaattacttccaaatggttttgtctctgaaagggtgatttcctgaatcatctctgttctcactaagtatagaaatgtatgtgcacatggagaacgactgtttacatacagaacggtagatgttattgcagatacaccgcttcataaaaaactttcattactacagagcggtaatcagtacgaaaaaggaaaacaagatttcagtgaaaaagtagtagcaaagcctcgcaaaagcggggctttgctactattcgtagttatggaatgaaacattctttaatctgtgtctgataaccgatctcttttactcaaacacttcttcgattttaccagttttttcgttgtaaacataaacactgttgtgttccgttacaaaaggagtaagtgagccaagtttaatgtttcggatgtaaactacatttgttggtaaaactcgcactaagctttcattttcattaatatcagcgatccaacggaacaatttgttctcttcttgtcccgtataaatgagatccataccgttttccgtattctccagtttgaaatataccttatgttttaaagacattttcggatagacaccttttacaacgtaaataccataatgttcatgtaaaagcttcttataggtatcgggcgtaagatcaatatccttatatttcactttttgtccaacatcaattctttctcgaataatggttaaggtatggatagcccaattgagagttccaatgctattatacttgatgcattcttcaatatttgtgaagaatgtttcatcaaaatttacttcttgtgttgccatttttgtcagttcgtttaatgataaattcataggagtatatatcatttgttaatatcaattatattatatccttgttccattttacaaataagctatttgagggaaaatacagacaaatcagagttattatctaataataagatagaatgaagtcaatcaataatcaggagaatcagaggtgattttgtaatgattgatgttgcaagaaggaagacgaagtattatcttttttgttgacaaaaaacaactacaatattattatataaagtaattatatcaagtaattatataaaataatagaaaggagaaactcatgacaaaagacaagataaaggaggttatggatgcctgttatcaggcaaagaggataagagatatgcttccggcattgcctgggggagtgacaccatcccatatccactatctggatactattagtaagttagaaaaaacggaaggtaaggtaaaagtcagtgatattagtgagaaccttggacttccgagaccaagcgtaacgaaaaccgtaaaagatatggaaaagcttggatttgtcgagaaagaaacaacagaaacggacggaaggtttgtttatattaagacgaccaggacaggaagagacctggttgataaatatgttgatgaatattttggtaatctttcggaagatcttggagggattacggatgaagatgcagacaagatgattgaagtagtagaaaagttctatatagttatgagtaacaggaagtaatatatgaatgcaaaagaaagatcagattttacacagggaagtatattaaagaagatgattccattcatgatgccaatacttggagcgcttatactccaggcagcgtatggtgcagtggatcttctggttgtgggcagatttggaacaacggccgggctatcagcagtttcaaccggcagtcagattcttaatcttgtaacgtttgtgataacgcagctggcaatgggaattactgttcttattgcaaggtatatcggtgaaaaacatacgagtcaaataggggaactgcttggtggagcaacgacagtgtttactacgatagctgtcgtactctttgtggtgatggtgttttttgcaaagccactggctgttcttatgcaggcaccccaagaagcgcttatacttacgtcagtgtatgtaaggatttgcgggggaggtattttctttatcgttgcttataacgttctttctgccatattcagagggctgggagacagcaggtctccccttatatttgttatggttgcctgcgtggtaaatgtcgtaggtgatcttgtacttgttgcaggattccatcttgatgccgcaggagccgcaattgctacagtgcttgctcaggcggttagtgtggtgctagctcttttaatgcttaaaagaagacaactgccatttaaaataacaaaaaaagatttcagagttaatagtcaatgtaaaagattcctgacagttggaattcctcttgcgcttcaggaatttcttacccagatgtcatttcttgcactgtgtgcatttataaataagctggggctggaagcttcttcaggatatggggttgcctgtaagatagtaaacttcgccatgctgataccaagtgcacttatgcagtcgatggcttcctttgtatcgcagaatgttggtgccggtaaggaggatagagcaaagaaggctatgtttaccggaatgggaatcggattaatcgttggaattatcgttttcgcaagtgtatggttctttggtgatgtgcttacatcgatattcacaacggatgaagcggttgtacaaaaagggtttgaatatcttaaggggtttgctccggaaacgattcttacagcaattcttttttctatgataggttactttaatggacatgaaaagacgttgtgggttatgattcagggacttatccagacacttcttgtaagactgccacttgcatattttatgagtatacagccggatgccagccttactaatatagggcttgcagcgcctgttgccacatgctttggaattatattaaatgtaatctttttcctttacatgacaagaaaaatgaaaaaggcatgagtgaaccaatgatttatccttttctagcaagaagactccgacctctaaggtgggagatgaattgcgtctgttacctacttgatattgcattctaatcatagcataatatattcagtcgcatgataaaaaaaggctgaaatacaatgaatttagataataatgcacattcagtattcttactgcaatatcatcttgttcttgtggttaagtatcgtagacaggtttttgatgatggtatttccagcagggcgaaagagatatttgagtatattgctccaaactacaatattactcttgaggaatggaatcacgataaagaccatatacatatccttttcagggcacacccacatacggaaataagtaagttcataaatgcatataagagtgcaagcagcagacttcttaagaaagagtttccgcagatacggcaaaagttgtggaaagaacatttctggagccagagtttttgtttgattacaacaggcggtgctccaattgaagtaatcaaaaaatatatagaaagtcagggacaaagggagcgaaaaaggaagtgacagagtggcaaacagagcatataaattcagaatatatcccaatgatgaacagaagattttgtttgctaagacttttggctgtgtcggaatggtgtataatcattggcttgatagaaagatccggcagtataaggaggacaagacaaacgtaacatataccatttgcgcaaaagaaatggcagcaatgaagaaaacggaagaatacggatttttaaaggaagcagatagtatcgcattacaacaatcgctcagacaccttgatacggcatttaagaacttttttaaacagccaaaaacaggtttcccaaggttcaaatcaaaaaagcggaataaaaacagctattctacggtctgcatcaaggggaacataactctgtctaatggatatttgagattacctaagattgggcaagtccggttaaaacagcacaggattatttcggatgaatacagactgaaatctgtaacagtaagtcaggcaccaagtggaaaatactatgcaagtattctttttgagtatgaagatcaagtacaggaaaaggaactgcaaaagtttttaggtctggatttttctatgcatgaattatatcgtgacagcaatggtaaagaacctgcctatccagggtattacaggaatgcagagaaaaaattagcgagagaacaacgtaagcttaccaaaatgcagaaaggttcaaacaatcgcaataagcagagacttaaggtggcaaaacttcacgaaaaggtttccaatcagcgaaaagacttcctgcataagcagtcaagacagatagccaatgcctatgattgcatatgtatagaagatttggatatgaaagcaatgtcacggtcattgaaatttggaaaatccgtttcagataacggctggggaatgttcacaacatttttgagatacaaactggaggaacaggggaaaaagcttgtgagagtgggtagattttttgcaagcagccagacctgttctgtttgtggttacaaaaatgcaaaaacaaaaaatcttgcgttaagagagtgggattgtccgcagtgcgggacccatcatgacagagatgtaaatgcggcggtaaatatcagaaatgaaggaatgcggctggtaaatgcatgaccttaacacaatataacacaaccgtgggacacacggggatagctcgcttatgcttagcacagtagtgttatcgaacgagaaccaaacttgccgaggttgggaagcccccacctctacaggtgggggaggatgttacgaatagtaagtctgatacacaggcgatggaaacggaaaattttggataaacagtaggaggtatattctatgccattgaaaattgttagaaatgatattacaaaaatgaatgttgatgcaattgtcaatgcagctaatacatctctattaggaggtggcggggtagatggatgcattcatcgtgctgccggcccagaccttcttgaggaatgtagaatgctccatggatgtcagacagggaatgctaaaattacaaatggatatcgtcttccctgtaaatatgtcattcacacagttggaccaatctggctggatggaaaacatcaagaacaaaaacttttagaatcctgctatgatacatcactgaatctggcgaaggaatatggctgtgaatcggttgcttttcctctgatttcttctggaatttatggctatccaaaagatcaggcattaaaagttgctgtagatatcattggaaattttctactggaaaatgagatgacagtcttcattgtaatttttgaccggaaggcatatcagattagcggaaagttgtttgcggatattacagcttatatagatgaccgatatgtgaaagaacactcggacagtcgggaagaacagagatggcgatcggagccgcttattggagaaagttgtttcgggtcagcagtggagaggatggaagcgaagccaagctataatgcgataagtagcaggactctggaggatgcgttgaatcagatagatgaaagtttttcggaaatgctgcttcgtaaaattgacgaatccgacatgacagacacgcagtgttacaagaaagcaaatattgatcggaaacttttttctaaaattcgctcgaataaattttataaaccgtctaaaacgacagtgctggcatttgctctggcattggaactgccaattgcagaaatgcaggatatgcttggtaaggcgggatttactttgtctcgttcaagtaagtttgatattattgtagaatattttgttgaacagggtaattataatgtatatgaaatcaatgaagcattgtttgcttttgatcagagtctgattggatcataaaacaatgaatgttgtttaatgtcgctttctatgcgaccactttctaaaagaaaatcgttatactatggctgcaaggtacgaaaccgagcagccatttttttgaccaggtaaatactagagcgtgtttgaaaaatcattccggcaacctgcacgtcccaatttgcggtatattttgccttcattcagttgacgtagcgtaatgccgtctaaaaacgtgtaatagcctcgtggtatattttgccttcattcagttgacgtagcccgctacgccgccctcattcaggcgaaatttcccacaaattgtaacgcacatcttacagaaagcatttttcaaacacgctctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctaggacagtaaacctaatagcgagattttcaggaggtaaggtataatgagaaagaatttaacagaaatcgtttttatccttgatcgtagtggatctatgagtggactggagcaagatacaatcggaggatttaattctatgattaatcagcagaaaaatgcagatggcgaagcattggtttctacgatattgtttgacaatgtaagtgaagttctgcatgaccgcataaatgtaaaggacatccagcccctgaccgatcacgattatatggttcggggatgtacagcattgttagatgctattggcggagcgatacatcatattggaaatattcataagtatgcaagacaggaagacattccggaacatacaatgtttgttatcacaacggatggaatggagaatgccagccgctattatagtagcaataaagtgaaacagatgattgagcggcagaaaataaaatatggctgggagtttctattccttggagccaatattgatgctgtggagacagccagtttatttggcattgatgaggacagagcagttaactatcaatgtgacagcgagggaactgctctaaattatgaagtgatcagtgaggcaatcagtgctgtccgatgcagtgtaccactgggttcaaactggaaaaagcgcattgacgaggattttaaaaaacgtggcaatcgcgagtaagtaattttctatgggtcttgtacctgtagataaagttccgcgttcttgttgtccctctgtatgtgtgctataattattaaatttagagaaagctgtgaaagaaggtgcagatggtatcctgctggccccggcaaattcgaattcactggtagatagctgtgagaaagttagaaagaaaaagattccagttgttttaattgattcttcgattaacagtacagaatttgatgtctgctacatgactgacaacatagatgcgggggagatggcagcgaaagaaatgcttacgatgctgcatgatacaggcaattctccgcaggaatcattagaggttggaatcttgttgtcgtcagatgcttcacaggcgatggtaaatcgggtttcgggattcttagattactgggcaaaatacgcaccaacaaaatgggagattacaaaagatattgctttaaatggcggggatgtgaaaaaagcagagtcggatgcagcgaaattattgaagaaaaatgagaatataaagggaatttatggatgtaataatacatctacagtggggatagcaaagacacttacaaaacaaaaacgaacggatattgttatggtcggatttgatatggcagaggagacaaaacagtttattaaagactcggattatcgaggagtttccttaatgcaaaaacaagaccagatgggatatctgggaatagggactttgaattcccttatcaatggaaaaaaatccgagcaaaaatattttgataccggggttattatgattgattctgattatcttatggagaaaaaagaaaagaaacgttatataggcttatcaagcacagacgccctgacaggaatcctaaaccgcagagcatttcaggtagaattagaagaacaaatccgtaaaaaagaaccgggatttttcatatttattgatgtagataactttaaatcctataacgacacctacggacataataacggagatttatgcctgaaacacttcgccaaagcaatacaggaatgtttcccggaaggaagtatacttggcagatatggtggagatgaattcgtggtttatctaaaagatgttacaaaagaatctgtatatatttatatggaaaaattccagaaaatgattgaagatttgactcttgcaacaggtgagcaggtatatttgtcagccagtgccggaggcgcggcattccctgaacagggagaagactttatctcgttgtgcagaagtgctgacgtagcattatataatgtgaaacagaatggtaaagcggcttttaagataaaataggaggtcgcagcaggtaagggagactggattcgctcaagtattatgcccgcagagcgagataatccgcagactgccagataagaaaaaacattggagaagtttatgaatacaagagaagaagcaataaaatatggtttatcctttgcgaatacctatgtagaagcaccatttcgtgatcagaactggcagcttgtacgggtgaagggaagtaagaaagcatttctgtgggtttatgaaaaggatggattcattcatttgaatgtgaaagtagagccagagtggagagacttctggagagaggtgtattcatcagttattccggggtatcaccagaataaaaagtattggaatacgcttatccttgacggaacgataccggaaaaagaagtgaaacgaatgattacagaaagttacgatattgtaacagacagcccgacaaagagaatctatgaggcagtaaaaaagattccaaaaggacacgttgcaacttatggacaggtagcggcaatggctggaaatccgaaaatgtcacgagcagtcggtaatgccctccacaaaaaccctgatccagaaaatatcccatgttttcgtgttgtaaactctaaaggagaactcgcaggagcatttgcatttggcggagaaggagagcaggcgaaacgcttggaggaagacggcgtagaggtaaagaacgggaaagtagacctaaaaaaatttgggataaatagtaattagcacaggcaaggaagctgtctttggcggcatttgctccagtaccaacgaatagaaaccagaaaatcaaatcacagcctgttggaaaaaattctcaacagtatttttatgccggttggcagaatgttcttgaaattgaggttctgtaaaaagaaccggagaagaaaaatcataaagactaaagaaatataagcgtattaaattgaggtgcagatggaatcctcaaaatggaagtattgaaaatctgagttactgcaggccaaacagacgccacgagaaagagaaacctatatttgtgattttcgtcgctgcgggttggtctgtttgttcctcctccctacaaatcactatttatctcttgttaacttgtgaatccatttatagcttcggaatctcaagaaaatcggaagtcccttaaatatctggtcagactgcaggcagatcactaccgcaggaatcggccatttccaccaaaaagcagcggagagagacagtggaagtacaatgccccaggtactgatcatattgacatagagtgaaaactttgtatcccctgcaccacggatgattccagaaccaacaggcatctggtatgccataccaaccataactattgccataatgataatgagctgttctgcaagttgagctgctgtcggacttaatgtatactgtgccaaaaggaaatcttttgtgaaataaagaacggcaccaagaattattccaatgcctacatcaagtacagaaagtgttcttgccgcagcttttacctcgtccaaatctcccttgccgactgccttacccatcataacggaagaagcagaggacatagcaagtacaacaactttcatatactgataaaatgtacttgcaacagaatttgccgcgattgcatcggaactcaaatgcccgagaatcgctgtctgcatcggtacggaaatcgcccataacatgccggatatgaagacaggaacagccactttcacataatccgaacgcaataatttatcaatgtgaaatactgccttgtctgaaaataactttaactttttatctatttttatcacataaataaatacaataaggaattctaaacatctcgatatcattgtaccaatcgctgcacctctgattcctaatttagggaagccaaatcgcccgtaaatcaaagtatagttaatacttacatttacgactaaagaaacacacgatatcacaaatgcaattcgtaccgtctccacactgcgaagcgcagacagaagcacctgtgtcacaagatacaaaagaaatgtatactttataatctgcaaataacttcctgcctcagacaaaatcgccgtatcagacgtaaaaaatcctaaaattgcgcctgaaaacagtgaacataaaagaatcaaaaagattcccagacaaaatgcaatctttaaaactattcccgtaatctgccggattggttccatccgtttctgtccccaatattgcgaggcaataacaaccagcccatcaccgataacaactgccgcctgttggataaggaaaaatacctgatttaccaacgacgcaccagaaagagcattctgactgtacgctccaagcatgatgttatcggccatattcacgctataagaaataaggttctgcaatgaaataataataagcagcggaaataatgctgcgtaaaaatttttatcgtgggagaaaaatgtttttttcataaaaaatagcctttctgtagatataaatcagtatcagtggggcattcttgaacttctgtcttcttcctcaaatctctccaactgatttcccgagctgccaatgagcagaactcagggagataaataaagcatatttgtgactttagtcgctgcggtttgaatgctcgctttacgcgctcgcatccaaaccttgctccaaggccacaaatatgctttatttatctccctgagttcgtctgcttcgccagctcggtaaatcaggctttttttgctccgaaatattctttggtgagctttacaactgttcccgataagaggaatacagcaatcaagttcggtatggacataagtccgttaaatgtttctgcgatactccataataatcccaagtctaccgttgctccgagaatcgcaacaagtgagtagacaatcataaacggacgaattgtttttgtcccaaaaaggaattcgatgcagcgagagccgtaaagtccccatccgattgtagtggagaatgcgaaacagcaaagtgcaatggctgtaaagatggatacccatccgccataagttgcagtgaagccctgaatggtcagttcagcaccggctgtttgtccgtaaggaacattaatgccgctgcataaaataattaaggcggtcagtgtacagataacgattgtatctgtaaatacttcaaagataccgaataatccctgttttacaggctgggaggtatctgctgttgcgtgagcgatggagccggtaccaagacccgcttcgttagagaaaatacctcgtgatacaccctttttcatactggtgaataaagtccctaccattccaccggtaaatgctgccggatgaaatgctccttcaaaaatagactggaatacagccggtatctgctgtatgtttaaaataacaacaccaagtccgagaaggatgtaaagcagcgccataaatggaactaaagtttctgttacttttccgattcggcggataccaccgataagaattaaggcaacagcgatagcaataacaataccgattacaaggttgatggtagaaagactgcctgatgaagcaaggttaaagttgagcatcagtgaatcaattgcagttacgattgtgttgacctgtgttgcatttcctgtaccaaatacggtcagaacaccgaaaagggaaaagagaaaagcaagccagtgccagtgtttggaaagtccatttttgatatagtacattggaccgccaacccagtcaccctgtgagtttttttcacggaagtgtacagcgagtgttacttcagaatatttggtacacattccaagaagggcggatatccacatccagaaaacggcgcctggtccgccaatcgtgattgcaccggctacaccggcaatatttcccgttccaacggttccggcaagtgcggtacataccgcctgaaacggagtgattgatccatccgcagcttctgatttatcaaaaatccgtcctaaagtatttttgatagagtaaggaaactttcgaatctgaatgaatcctgttcgaaaactgagataaagtccaacaccaatgatacagaccattgctggaataccccagataaagttgttaacagcgctgttaacggcttctattgtttttagcattagtacagtccccctttagcttactaaagtaaagattataccattgttttattaaataacgcaagagttttactcttgtttttttctgaaatttgttttatactgtaaaaagttcaatataagaccagagcgtgtttgaaaaatgctttctgcaaattgcgatgtgcaggttgctggaatgatttttcaaacacgctccaggggagcttgtcgtttttaggaagctgagagtaaggttgtgccttagacccttgaacctgtttggataatgccagcgtggaagagtttgcaaaagaactttcaataaaaagtttatcaggaagattttaaaagcagcgtcagcattatttgctggcctttttcttttttatctgcaggaacttttaataagaagacataaattcttttttagatatagccaatggcagattgcagatcagaaaagaatagcagactttttatgcggcataaatacaatatttatacaaaatttatacaaattatatggaggaatgaagaatgaatgcaagtgtagcaattcaggttttaccatctgtacaggatgaagaagaagtaatccgtatcgtagacgaggtcattgattacatcaaatccacaggattaaactattatgtaggaccatgtgagacatcaattgaaggcgattatgatactttaatggaaatcgtaaagaactgccagttagtggcagcaaaagcaggatgcaaagcaatgaacacttatgttaagatttcttacaaggcggaaggagacgtgctgaccattgacaaaaaggttacaaagcatcaccagtaagcttccagcagtagtagcattatgccttctgattctgctctggcagtttttatgccagagtggggcagttccggcatacatgctgccttctcccgtgcaggtgataaaagcattagtgactgatttgccaacgatattagaacatgccagtgttacgttgcaggaagccttttacggactgtgtatcggtgttggtttagcatttgttatggcgacattaatggatcattttcagatacttaacaaggcgttgtatccgattctgattatcacacagacgattccgacaatcgctatcgcaccattgcttgtgctgtggatgggattttacatggcaccgaaaattactcttgttgtaatcacaacttttttcccaattacagtaggcttgcttgacgggtacaagagcgtggataaggattccattgatctcatgcgggcaatgggagcaaccaaaatacagatatttttccatgtgaagtttccgactgcattgccgcagttcttttccggtttaaagatttctgcttcttacgcagttgtaggagcggttatttctgaatggctcggggatttgagggacttggtgtttacatgacaagagtttcaaaggcatatgcttttgataaaatgtttgcagttattatttttattgtcattatcagtcttcttttaatgggagcggtcaatctcatcaaaacactctctctgccgtgggtgagagtggagaaaaaggaagctttggaataaaaaaagatatatttggatatttaaaatatcctatattaaaatcacattcaaagtaatctatatggatatataatagcatccaaaagaatccatatgggcatatataataatatctaaaagaatctatgtgattttgtacaaatagtatctgaaaatttacaggaggaaattatgagaaagttaaactggaaaaaaattgttgcaggaactttgagtgcagtaatgttattatctgtaactgcatgtggttcttctagcacaaagagcgagagtgcaagtacagaagcaggtaaaaaggagcttacaaaagtaacattctgccttgactggactccaaatacaaaccacacaggaatttacgcagcaaaggcacttggttattacgaagatgccgggcttgatgttgaaatcgtacagccaccggaaaatggagcagcaaccatgtgcgcatctggtcaggctcagttcgccatcgaagcacaggatacaatggcagccgcatttgattccgataacccacttggaattacagccgttgcaggactgattcagcataatacatcaggaatcatttccagaaagggagatggaatttccagcccgaaaggacttgaagaaaagacttattccacatgggaatctccaatcgagcaggctactttaaaaacagttatgaaagatgagggagcagacttcagtaaagtaaaattaatccctaacaacatcacagatgaaccagctgcattaaaagcaaaccagacagacgctatctgggtattctacggatggggtggaatcaacgcagaagtagaaggcgttgactgtgactactggaacttcaaagatatcgactctgtatttgattactacacaccagttatgatcgcaaacaatgacttcttaaagaattcaccagatgaggcaaaagcattccttgcagcaaccaaaaaaggataccagtacgcgattgataatccaaagaaagcagcagaccttcttatcgcaggagatgacacaggttccttaaaaggttctgaagacttagtatataagagtcaggaatggctttctaaacagtatgtagcagatgcagacaactggggagttattgacgagacaagatggaataacttctacaaatggctcgcagagaataaactgactacaaaagacctcacaggaaaaggtttctcaaacgactatcttcctaaataatttgcagggatgggcgaacagacagacgagccgccaaagacagaaaagcgaatcgccatatagccatatctgtggtctgggagcaagtgttggatatgagcgtataagcgaatattcaacgcgccgcgacgaaaatcacagatatggctatatggcgattcgcttttcgtcaactttgtctgtggcaaattattagagaaaggataatataatggttcttttaaaggctgaacatattacaaaaaaatatagtgggagaactataatcaaagatattaatatcgaattgcataaaggagaacttatttcacttctcggagtcagcggttctggaaagacaactcttttccatgtcctttctggactgacaactccagaggagggaagggtattgcttaatggtgaagatattacttctaggccaggacagattagttatatgctccagaaagatttactttttccacataaaaaaataatcgacaacacggcattaccgttggttcttcatggaatgagcaaaaaagaagcaagaaaaaaagcacagacgtatttcgaagactttggacttgaaggaacagagtatcaatatccttcccagttgtctggaggtatgcgccagagagcagctctgcttagaacatatctttcttccaatggagttgcacttcttgatgaaccatttagtgcactggataccattacgaaaacagcaattcatagatggtatcttgaagttatgcagcatattgagttatctacaatttttataacacatgatattgatgaggcaatccttctttcagacagaatttatattctcaatggaaagcctggagaaattcgagatgagatcatcattaaagaaaagaaaccacgggcggaggatttttacctcacagatgaattccttgcatataagcgggaaataatagcgaagctttagattctgatttgccgcaggcaaggagacacctctgtagagaaacctataatcagagcagaggaccacattctggcgaatattcaggtaactgccgattataaaaatgtctaacataagagcaatcatagctttgtgtttcaagttaaaggtggaatcaatgatggcctccatctcagagcgggaaaggacaacagggagatagcttctcttttcatgcatagtaattaacctccataataaaatcaacaattgtgaaagaaacaatgttgaagtaggatgtttttgtcactgctttttttatttttataaacaaaaatcgctgcacatagctttcgcaagccattgcgcagcgattttgttcaatcagaatttccatttcgtaaatcctatttttttcatgctataaccatattttttcataagtttgttacaggaactaaaggtatcgtttatactcgaaagaaaagaaggaatatctatagaagaaggtggtccaatataatcgtaattatcttcttcataatctgcctcaaaatgtgagtttatttttgtataggaaaatcctttactttttccatcatagttcattgtaatcgttccagttgattctacagtagagctaggattccaattggaaattttagagaaaacggttccctcctgcccagatattatattcatagttatagttgtcttatagttagcattctggttacaaggataaaaattatacataaaacttatctttccaacctgaggatatgccacaatataagtcatatgcaattcatctgttggataaaggatttctctggaaagtattcgtgtattatttttccctttcttaccctttttacgaacgaaaagataaaactgctttgcattaaagcttttttgcgtcattacagttactttacatttaagttttttcttatttactttagcgtaaatgtaacaagtaccaggttttacgccttttacagtgccattggtgttcacttttgcaacttttttattgctagaacaccacttgaccttttttgttgttcctttgacttttaatttagattgcttgccttttacgagagtgatatttgttttgttcagtttaactttcgatgcagcatgtacagttgttggggaaaaaacggaaatagacaataaactactaatgagcaaaatactgaaaaagtaattagtcattcttttaagaaaaggtgttaaatgaactctcatagtatccctccttgctgatgaaaaggtacagatcccgaatcgtcagtttatatgaaaattatatcatgaaagaaataaaaactctatagaaattctgattgccgcagtctcatactgtccctttacgataggattctgaatacacatttcttcttttacagcaagaagactccgacctctaaggtgggagatgaattgcgtctgttacctacttgatagagcgttctaatcatagtataatatctttagttaaataataaaaattaaaatacaataaatttagataataacgtacatttagtactctgactataccagcatcgtgtgcttgtggtcaagtatcgcaggcggtttttcgaggaaaaggaagtgttggaatggcaaacagagcatataaattcagaatatatcccaatgatgaacagaagattttgtttgctaagacttttggctgtgtgagaatggtatacaatcattggcttgatagaaagatccggcagtatgaggagaacaagaccaacgtaacatatactatttgtgcaaaagaaatggctgcaatgaagaaaacagaagaatacggatttttaaaggaagcagatagtgtcgcattacaacaatcgctcaggcatcttgatacggaatttcagaactttttcaaacagtcgaaaacaggtttcccacggttcaaatcaaaaaagcggaataaaaacagctattccacggtctgtatcaatgggaacataacgctatctaatggatatttgagattacctaagattggacaagttcagttaaaacagcacaggtctgttccaagtgaatacagactgaaatctgtaacagtaagtcagacaccaagcgaaaaatactatgcaagtattctttttgagtatgaagatcaagtacaggaaaagaaactgcaaaagtttttaggtctggatttttccatgtatgaattatattgtgacagcaagcagccagacctgttctgtttgtggttacaaaaatgcaaaaacgaaaaaacttgcgttaagagagtgggattgtccgcagtgcgggcccatcatgacagagatgtaaatgcagcggtaaatatcagaaatgaggggatgcggctggtaaatgcgtgaccttagaacaaatacaaccgtgggacacacggggatagctcgcttatgcttagcacggtagtgctatcgaacgagaaccaaacttgccgaggatgggaaaccccaacctttacaggtggagggaggatgtcacaataatgatatacaaatatactgtaaagtaagcacaatattgagctgtagttacctaaaagaaactattggaggtgtaagcatgcctgaagtaaagatggagcaggaggagaagattccggcttgcccggtggaaacaacgctaatgcttatcagtgataaatggaaagttcttattttgcgggatttattgccgggaacaaagcgatttggagaacttcgcaagtcgattggtcatgtatcgcagaaagttttaacagcacagctgcgtcagatggaagcgagtgagcttttgaccagaaaggtgtatgcggaggtaccgccgagagtagagtacacattgacagagttgggttacagtttaaaacctatactcgatgcgatgtcagagtggggagaaaattatcaaaacatgaaggagaaagaagtgtgaatgagaaatcaatagaaagtaacggtatgaataatggtagtaatagaaagaatggaaatgtcagagaatcatttaacagtcagtggggatttatccttgcctgtatcggttctgcggttggcatgggaaatatatggatgttttccacaagggtttcgctttatggcggtggagcatttctgattccatatattatttttgttgttctgatcggagcgacaggtgttatcggtgagatgagtcttggccgggcagcaaggtctggcccaattgatgcatttggcatgatctgtgagaaaaaaggaaagagaaagctgggagaagctcttggaatgattcccgtacttggttcgcttgcgatggcaatcggctatactgtagttatgggttggattttaaaatatgcagccggaacttttacaggagcaaccctcgccccagagagtgtagaagatttcggtgggcgttttggcagtatggcatctgcgtttggaaacaatgtatggcaggttatcgcgttagctgcctgtatggcgattttgatgtttggcgtgggaagaggaattgagaaagcaaataagatactcatgccagtattttttgtgttattcgtgattcttggtatttatgtatttttccagccgggtgctgcagatgggtatcattatatctttcgtgtggataaaaccgcattaatgaatcctaaaacgtggatatttgctttaggacaggcatttttttctctttctgtcgcgggaaatggaacacttatttacggttcttacctttctgatgaggaagatattccggcttcagcggcaagagtagcattatttgacacgattgcagcgatgcttgcagcacttgtcattattccggcaatggcaacaactggggcacagcttaaccagggaggcccgggattgctgttcgtttacctgccaaatctaataaaatcaatgccgggaagtacattgattgcgatgattttctttgttgcggtactatttgctggcatgacttcattgattaacctctatgaggccccgattgctactgtacaggaaaaattacacgttggaagaaaggcagcctgtctcattattgccgctatcggtgtagttgtatctttgatgattcagggaattgtatccagctggatggatgtcctttcaatttatatttgccctcttggtgcaggactggcaggaattatgttcttctggatagctggtaaaaagtatgtggaggtacaggtcaacaagggaagaaaaaataaatttacagaattatattttccgatatgtaagtatatttatgtgccggtatgtattttagtccttgtactaggaatcgcactcggcggaatcggatgatataaagataaaaatgtaaaatgtattgggacgtaccgagaggtgcgagttatggagagaaagttatgagaaagtttaaatatacaatcaaagaagaacagggaattcatgcccgcccagcgtctttcctgattcaggaagccagaacatatgaaagcagaatcactcttcgggtaaaaggaaaagaagcagatgcatcgaatattatcgctgtgatggcattggatgtgatgtgcggacagaaagttgaagtagaaatatgcggaaccgatgaggaagtcgcatatcgagggatgaaaaagttctttgaggaaaacctttgaagaacttttgattttacagtagaacggacgaatccgaagaagaaaataatctatatttgtgactttagttgctgcgctttgaatgctctcttacgcacttgcatccaaaccttgctccggggccacaaatatagattattttcttcttcggattctgtctgtggctgttgaagtaaaagattcttttctgccgaatcagccaacttctttgatgatgtaaacggattgagagagaagatggaatataatatgaagaatactgtctaaatatcaatcttcccaaatttatcttttggagtttgtttgttttgcagcctcacaaccctcagaatttcttcattttattgacaaaactttgttttttactgtaaaatgagattgatagtatcaggaataataggagaaatttatgggcaagtcagaaaagcagattgaaaaagaaaaagcacgtaatcagaggattatagatactgcctttcagatttttgtagagaaaaaaatagaagcagtgactatggaagaaattgcaaggaaagcaggtatcggaagagcaacacttttccgctgctattcaagtaaaccagaacttgttatggctgtatgtactgcaaagtggaaggcatattttgataagttagatgcgattaggccactggaaagtatccacgatattccggcgattgatcgttttatatttacattagatggttatattgatatgtatcagaatcataaagatttactccagtataacgacaactttaaccactatatggtacatcaggaaggcattgctgcggagaagtatgaaaaattttataaatcattatattcgatgaacacgagattacactggatgtatgagaaggcaaaagaggataaaacattccgtacagatattccagaagaacagttcttccgggtgacatttcattcgatgatggcaacctgtgcgtattatgcggggggatttatctggggatcggaagagaataaagattataccgaggaactcataagattaaaagaaatgatattgaagtacgttactatttaattcattagatacactgcagacgaagccattgcccccaataaggcatatttgtgattttagtcgcggcgtgttgaatgttcgctttatgcgctcacatccaacacttgctccgagaccacaaatatgccttattgggggcaatggcttctgtgctgtggctggagaagatgaattaaacagggggaggggatttggggacagaagctgatgtattccgcttacttgacaatgactggtagcagagggtatgatttgacctgcctatatgtaatagtaagataaaaaaatctatctacaatattctgaaagcaagcagaaaacttctgcctttcccctcaaatcctcacaaccactatttaattcaaataaaatccagccaaagacagcccgggaagagaaccgataccctatatttgtggcctcggagcaaggtttagatgcgagcgcataaagcgagcatttaaaccgccgcgactaaagtcacaaatatagggtatcggttttcttcctgggcgtctgttctttaatgaattaaatagtaattataaccacttgatttgagaatgggataaatatataatcaggatatattttgatagaatatatagaatcttaatacagaaggagaacttttaacaaggataaatatgaatttcactggtgaggagtaagtttatgaacatttttgacgttatcggtccggttatggtaggaccttcgagttcccatacagcgggagcagtaagaattggttatgtagcaagacagcttttgggcgaagaagtgagagaggcaaagattttactttatggttcttttcttgcaacaggaaaggggcatggcacagataaggcactgacagctggccttcttggaatgcagacggatgattaccgaattccaaaaagtattgagattgcagaggataaaggtatgaagattgcttttggcgaggcggtattgaaggaagcacatccgaatacggcacagctttatttgaaaggcatttcgggaaagacgatggagcttgtgggccagtcgcttggaggcggccggattaatattgcggagattgatggcattgagacgaatttctctggggagaatccaacattgatcgtgcataatctcgatcagccaggacatgtatcggaagtaacttccatgcttgctcataaaggtgtgaatattgcgaccatgcagttatatcgttcctcaaagggtggtaaagcagttatggttgtggagtgtgatcaagaagttccgcaggagggaatccgttggctggagcgagtggaaggtgtactgaaagtaacctatcttggaaaatcggaggaaaagtaaatgatagaatatcacagcatacagaatatattagacctttgtaaagaacaggataaaaagatttgggaagttgttttacaggccgatatggatgagagcggggcatcaggagagcaggtttttgagaaaatgcgttttatgtatagggcaatgcaggaggcagaccagagttatgaggcaaatttaaagtcccagagcggaatggttggtggagacggtgaaaaaatgcgtcagtataatgccactgggaaaaatttatgcagtgagtattccagtcttgcaatggaaaaagcattaaagatgggagagtcgaatgcctgtatgaagcggattgtagcagctcctacagccggctcctgtggagtaatcccggcagttcttttaagttacgaagaaaataaaaatgcagaggaagatgaactggtaaaagcattattcgtcgcttctggtatcggaaaagttgtggccgaaaatgcttcgattgccggagcatttggtggatgtcaggcagaaatcggaacggcaagtgcgatggctgccggggcattggcatatctgcaaggtgcagataatgagcagattatgcaggcagcaaccttcgccttaaaaaatatgcttgggcttgcatgtgatccggttggcggtctggtagaagtcccttgtgttaaaagaaatgtagcaggagttgtaaatgcaatttcaagcgcgcagcttgctcttgcaggtattaccagtgtgatcactccagatgacacgattgacagtatgcgccggataggaaatgatcttccatcctgcctgaaagaaaccagtaaaggtggtcttgcagtgacagaatcggcaaaacgtattatggaacagtttaagagtcattaaacttctggtttgccgcaggcaaaggagacgccgctgaagaaagcctatcccctatatttgtgactttagtcgcggcagtttgaatgctcgcttatacgtgctcgcatccaacctttgctccgaggccacaaatataggggctaggctttcttcggtggctgtactttggttgtagaagtaatatcagaattttatattggagagatttgagaaagatttcagatgattgtagctttctggaaaatggaatattaaagattgacatgaggactgatggagattcaatattttctggcttttcctttacatcttttaattgatttgaatgctttagaataaccagccgctatagatatttttatcggattattcaaaaaattaaaaagaagcccttgttataagcttgaattttgtgactttgcgctgtggaatcttgactgtaaccttgcgagctcgttttcgagcaaggttgtcttatcaggcaggatggaacgtttagcgcaacggaacaaaattcaagcttataacaaggacttcttttttatattttttgagcaatccgcttatagattcttctgtagcggcgtctgttccatagtctcacaaatcagaagttagcagattttaaaagtgtgaagaataaatttgccacaccgcaaaggcacataataagaatcggattcagcttccattttctaagagcaataaaggctgcaataaaaagaaaaagagcgaatacatttactgaagaaatgtgtaaggctttcccggaaagaacagcggtctgaaacatagaaaatccggcagcagtaatcagtgcaacaacggcaggccgcagactcgaaagaatattgctgattgctgaagtttctttgtatttacaatatacaagtgccagaatagataccagaatacaggaaggaaaaatcgaaccgaaagtagcggcaagagcaccggggattccagcaatctgcagaccggtaaatgtggcagaattgacaccgattggaccaggtgtcatttctgcgattgtgataagattcgtgaattcgttcatggtaagccatccatgagtttctacaacctggctttgaatcagcggaattgcagcgtacccaccgccgacactaaaaagcccaatctgtacgaaactcagaaataattgtatataaatcataatttcgtctcctgtaagcatttttgtttctgtgtttccttctgtgtttgcctgagaaaaaatggcctgtactgataccatataaactgaatgatgccgatacatgcggctacaagaataatataaacaacatttacttctaagaaaaagtcacatacaaaagcagcggtcatgataaaaatagacaggctgcttttttcttttaatacactttctccaaggctgcacgcagcatctaaaatgacggcagcaactcctgcctgcattccttttaacacgacagctacccatacatttgttgaaaaaatagcgtagaaaaaagaaacgacagataaaataatcatcggtggaagaattgttccgagcgttgccacaatcattccggcaaaaccatatacattccagccgaccaaaatagcagcatttacagcaatcgctccaggacaggactgtgcaagagcggtaaaatcgagcatttcctgctcatcaatccaatgtagttcatctacgaatttatgcttcataaaagtgacgatgacaaagccgccgccaaatgtaaaagcactgatataaagtgttgtaagaaataacacccatagtttgtgcggtttatttttcatgaaatccctcttactttctagagagtgtttgaaaaattattcctgtaatctgcacaccctactttgcggtatattttacagaaagcatttttcaaacatgctctaaagatatttacaaattaagtctttttacattattaatatatcacttgcgagattattttaaaaatactataattataataaagttcatagataaaaaactataaaatagaaatcggatttgagaaaggaggaatagcgtgtccattcgccattttagaattttcatcgccgtagcggaagaagaaaatatcacaaaagctgccaaaaagctgtatttgacacagccaacggtaagtgttgccataaaagagatagaagagcattatggggcaagattttttgagagaattaatcagagacttcatattacagaagaaggaaagagatttctcgactatgcaaagcatttcattgcgatgtatgatgagatggaaattgcatttaaaaatacagactttaccggaagactccgagtaggagcgagtgtaaatataggaacttattatattccaagactcatccgggaatttcgggacaggtatccgggaataaatgtgcaggtaaagataaatacaaccgctgttgtagaaaaagaactgttagatggaaagttagatctggcactcgtagggggaacgatacagtcagaacatatcgttgcagaaccgctattttatgagaaatataccgccatatgcgccccggagcatccgatggcaggaaaaacggtaccactagaagaatttatgaaagagccgcttttatccagagaaaaaagcagtggtgcatatgaagtattccagagtgcggtaaatcagactggacttaccgtcactccagtatgggaaagcacatcccagacaacacttatggaagcggtacattatggattaggggtaacgatcgttccagagcagatgataaaaagagaagtaagagaggggcgattatcccagattaccttctccgatttctctttccagaatacgattcatatagcctatcatcatagcaaatatctgtctccatcgataaagaaatttattcttctggtaaaaactttggatcctccagaatttgttccagagtaatattgtaaaagaaatcgtgaaccagtgaatcaaacttcttccacataggaagcgtccggcactggttcgcccttggacaatcttccgcatcatccataagacaagccacaggagcaagcgttccttcggccacttccagaatctctccgacactatattctgccggtgtgcgggtaagctggtatcccccacccttaccacgcagtccttttaacatcttttgttttacaagagacttcaggatactttccagatatttatcggaaatagcctgtctctttgcaatatctttaagggggatatacccctcattgccatgctccgctaagtctaacatgacgcggagggcataacgtcctttggttgaaatcataaaataatcctctttcgtaataatatgactttattataacatagtaggttagttcgttaaaggggggacagacgcccgagaagagaaccgatatcctatatttgtgtctttagtcgcggcggtttgaatactcgctttatgtgctcgcatccaaaccttgctccgaggccacaaatatagggtatcggttttcttctcgggctgtctttggctggattttgtttgaattaaatagtggttggagggatttggggatgaaagttgaagtctttgatttattatccgtaggtccgtgcactgtttaattcgtttgttgtttactaatgaattaaatcgttagacaatattttttcaacttcagtaactggcttttctattacttcagcaattacttccaaaggaatgcccgctttatacattcgttgtgtatagctggttgttgcttcgttaaatccttctcttcgaccagattctttatggtctgtccatgcgtttctcatgtttattgtatcctccttttctggaattgaaaaatgtaatcctgtaaatgtgtttataatctgtgcagcagtaacggaaagagcagaatagcctggatcagaaagtagaatatccatttgttcttcatcagaaattacttttaatatatgcataagtcggccaaattctgtatgaaatttcgtgaaattagaaatattgttgcatgatattaaatgaagtttgtaatctggaagaaattctttaagggattcatctgtctcagaaaacatctcctgaaggctttttgccgcatcccacccgtcattgccaaaatatatagtaacagtaataactgggacaaggcgatcatctggatgccatcccgataaaaattcttctgtagtttctttaaaatttggattttgttttcgtatttttctgtatttttttgttttttcatttacttgtgcagaataattaatcgcatcatagagcatatttctgacaggcattgcataatggatatgagattgattctcaactccaaacagtacataaagggtatttttatattcttttgcaatacaaccttttaaaatatcccgaaatttttgtattgtagctaattctccgcgtttcccgagcggaagagtgatttcagaagtatctcgttcaattaaattctctggaagtattctttgttgcccatcataaataagataattaaaaacatcagcaaaaatctcattattggacaaatattctttagtaagtgcatcagcttgtctcataaacactcacctcgaaataaaaattattttgtctgaatatatgatacaataaaattaacataaaatcaatatttttccaaaaaataacatataaaaattaaatgtagagagattgtagctgcctgatttttcattttttgtctttggtaaaataggagaatttaaatatggaaattttttgcaagtccgtatccagccaaagacagaagccagagagctatcgaatccatatttatggcctgagagcaagtgttgaatgcgagcgtggggcgaatattcaacccgcagagatagagtcacaaatataggatattttttctctttgggagcgtctatgtagccttgactgcatcaaatcactatttttttgaaaaaaatttatccctcaaaaactgcatggttaagccatatttcccgcttttcaaaaattgtttttaaataaatccctataaacctatttacaaagtaggttaatagtgctattatcatagccatgagatacatgaaagaaataaatcaataaaaaatgagattttagaataaggaggaacaaagcaatggctaacatttataaaggtacattaggattgatcggaaatacacctcttgttgaggttgctaatattgaaaaggaattaggattaaaggcaagagtattagttaagcttgagtacttcaatccggcaggaagtgttaaggacagaatcgcaaaagcgatgatcgaagatgctgagaagaaaggaattttaaaagaaggttccgtaatcattgagccgacatctggtaacacaggaatcggtcttgcatctattgcagcagcaaaaggatacagaatcatccttacaatgcctgagacaatgagtgttgagagaagaaatattttaaaagcttacggtgctgagattgttcttacaagcggagctaagggaatgaaaggtgctattgcaaaggcaaatgaactttcagaagaaatcgaaggaagcttcattccgggacagtttgtaaacccggcaaacccggcaatccataaagcaacaactggtcctgagatctggaatgatacagatggagaggttgatatctttattgcaggtgttggtacaggtggaactttaacaggtacaggccagtacttaagagaacagaaaccagaagtgaagattgtagctttagagccagatacatcaccagttttatctgaaggtaaggcaggcccacataagattcagggtatcggagctggatttgtaccagatgtattagatacaaagatttatgatgagattttcagagcaacgaatgaggatgcttttgcaacagcaaagcttttagcaaagaaagaaggaattttagtagggatttcctccggagcatctttacatgcagcaattgaatatgcgaagaagccagagaacgaaggaaagactattgtagcgcttcttccagatacaggagacagatattactctacagcattatttacagaataatgccaggcattcttgaatctcaaagcttaatgcataagacaggtacgaaatccagtataggatttgtaattgaatagaggaaaagggtgataaataaatgaatctttcgaagaaaagcaggtatgggattaccgcattgatcgatctggcagtatatgccaaagaccagtgcgttcagttaagcagtatcgcagagcgcaataatatatctgtaaagtatctggaacagattttttcgagtctgagaaaggccggtctggtaagaagcgtaaagggaccacagggcggttatcttttagcaaaaagaccagaaagtattaccgtagcagatgtaattcatgcgttagatggaagctatcttctggaagatgaaagaagtgtggtaagcggaacagacgaaaagggaatatccactgcgatacagaaacttctgattgatcagatgaatgatcagacggatagattattgaaacaattaacattaagaaatctggtagattcctcaatggagtacagtcaggttggacatgaaatgtattacatttaagtaagattaaaattaaatttttagattagatagataaaaatagatagaatttttagatactcaagagggtagacatgaagacaaagagattagagacagatgtgttaatcatcggtggaggaacagcaggctgctttgctgcctatactttgggaaaagaagcaggggtaagcgttctgatagcggaaaaagcgaatattaagagaagcggctgtctggcagctggggttaacgctttaaatgcatatattacagaaggacatatccctcaggattatgtggattacgcaaagaaggatgcccacggaattgtcagagaggatttgcttttatccatgtctgagcgactgaatcatgtaacgaaggttcttgatgatttaggactcgttatcctgaaagatgagaacggtaagtacgttgcaagaggaaacagaaatataaagattaacggtgaaaatatcaagcctcttttagcagaagcggcaatgtcacaggacaatgtcacagtgcttgagagagtgaatatcaccgattacataatagaagagaatgaaatcaaaggagcctggggctttaatatagaagaaaatgttttctatgatatccgggcaaaagcagttctttgtgcgactggtggagctgcagggctttaccgcccgaacaatccgggattttcaagacataagatgtggtactccccatttaatacaggagccggatttgcaatgggaattttagccggagcagaaatgacaacatttgagatgcgttttatcgcattgcgatgtaaagatacgattgcaccggttggaacaatcgcacagggtgtcggagccaggcagatgaactctcacggtgagatttatgagacaaaatacggtcttacaacttctcagcgattatatggaacagtaactgagaacagagagggacgcggtccttgttatctaaagacagacgaaatcagtgcagcacaggaacaggatttatacagagcgtacctcaacatggcaccaagccagacactcaaatggttagaaggttcgagaggaccggcaagtgagaatgtcgaaatcgaaggaacagaaccttacattgtaggtggccataccgcaagtggttactgggtagataacggcagaagaacaacagtgaaaggtttatttgccgccggagatgttgccggaggatgcccacagaaatacgtaaccggagcattggcagaaggcgagattgccgccgaatccatgacgaaatacttaaaaaacttaaatgcagacagcgaaaaatcaaatgctataaaggaaattgaaacaaaaatagataatgcttctatattaaagaaaaaagagtatgaagcacatttgacagcagaaggaaaagacagcgaagatacatttttcattactgcagaacagcttgaagaggcaatgcagaaagtcatggatcagtatgccggaggaatcgctaccgattatcagtacaatgaagagagactggtaatcggtaagaagagaatcggtgaattacttggcatgattgatgaactcaaagcaaaagatatgtttgagttaaaagatatctacgaagtaagagagagactgattgtgtgtcagactttgattgaacatttaagagctagaaaagagacaagatggcacagctttggagagaatacagactatccgaaagagagcaatcagtggcttaaatatgtgaattcaaaaagaaagccagacggcgggacagaaatcattttcagagaactggtgacaggaggcaaggtatatgagtgtacggattttacagaataaatgtgtgggatgcggaaaatgcctttccgtctgtcccgggaatctcttaaaaaaaggcgaggacggcaaggtacatattcgaaatatcagagactgctggggctgtaccgcctgcttaaaagaatgtcacacgggagcaattctttacttcttaggtgctgacatgggaggcatgggttccatgctttctgtcaaggaaaaaggcgatgtccgcatatggcgtgtcgatagtccgaacggtgagacaaagaccattgagataaacatgaaagattctaacaaatattagcatagaaaacattttaaaggaggaaatgagatgggaacattatcacatcttgatgaactggaagcagaagcaatatacataatgagagaagtagcagcagaatgtgaaaagccagttatgctttactcaatcggaaaggacagttccgtaatgctgcatctggcaatgaaagcattttacccggaaaagccaccgttcccatttatgcatatcgatacaacatggaaattcaaagaaatgatcgaatttagagataagattgcaaaagaaaaaggaatcgacatgattgtatacacaaatgaagaaggtgtaaaacagggaatcaacccatttgaccacggctcagcctacacagacatcatgaagacacaggcattaaaacaggcactcacaaaatacggatttaccgcagcatttggcggcggtcgtcgtgatgaagaaaaatcaagagccaaagagagaattttctcctttagaaataaagaacaggcatgggatcctaagaaccagcgcccggaagtgtggaagttatataatacacagattaaacagggtgaaagtattcgagtattcccaatctctaactggacagagaaagatatctggcagtacatcaaacgcgaaaacatcgaaatcgtaccactttattatgcggcagagcgtccggtagtagagcgtgacggcaatatcatcatggtagatgatgacagaatgaagcttcgtccaggtgaaaagattgaacataagagcgtaagattccgtactcttggatgttacccgttaacaggtggtattgaatctaccgcacatacattagacgagattattgatgagacacttagcgcagtagattccgagagaaccagccgtgttatcgaccatgacggcggagcagccagcatggaaagaagaaagaaagaggggtacttctaagatgaaaggattattaaaatttattacatgcggaagcgtggatgacggaaaatcaacattaatcggacatatcctgtatgactccaagcttctttatacagaccaggaaaaagcactcgagcttgactcaaaagtaggaagccgcggtggaaaaatagactactctttattacttgacggattaatggcagagagagaacagggtatcacgatcgacgtagcttacagatatttcacaacagataatcgaagctttatcgtagcagatactccaggacatgaagaatatacaagaaacatggcagttggtgcatcttttgcagacttagccgttattcttctggacgcaacacagggcgtacttgtacagacaagacgtcacgcaagaatctgtgcattaatgggaattaaatatttcattttcgcagtaaataagatggatcttgcaaagtatagtgaagaaagattccgtgaaatcgaaaaacagatcgaagcattaaaagcagaacttggactggaaaatgtatacatcgttccagtatccgctacagaaggtgacaacgtaacaaaagcttccgacaacatgacatggtatgaaggaaagccaatcctttctatcttagagcaggttgatattgatgaaaatcaggaagaaggcttctaccttcctgtacagagagtatgccgtccaaatcatcagttccgtggattccagggacagattgaaagtggaagcatcaaggtaggcgatgagattactgcattgccaagtatggaaaaagcacacgttaaatccattcatgtaacagacaaagatgtacagtctgcagaaaaaggacagccggtaacaatccagcttgaccgagaagtagacgtatcaagaggatgtgtcttatccgcaggtgcaggagaaaaggtaacttcttcagtagaagcaactctcctctggatggatgatgacaaacttgaaagtggaaagaactacttcgtaaaattaggaaccagattagtacctggtatcgtttcaaaaatcctttactccattgatgtaaatacaggagaacagaagcccgccgattccttaggaaagaacgaaatcgcagagtgcgagattacatttgtagaccgtgttgtagcagatgaatttaaggatcacaagacattaggagaattaatcctgattgaccgtgtaaccaatatgacttctgcctgcggtgttgttacagaagtaaaagaagacggacaggaagcaggaaagaaagcagatcagcttcgtgccgtaatcaaaggacagagagcagcaaccattccatttgaccttgcagatgacaatatcacaagaagctttgtagaacaggtagaaaaagaactgacattaggtggaagacatacatacctttacgcaccaaaagatgatgagccagtaggacttgtcgtaagacatttaaacagagcgggtattatcgtattacttgttcttaataaagacttaaagaataaagaagaaatcaaaaactccttatccaagtacagcaaatacattaagaactgggaagaaggagaaaaaggagacgtggacagcacagtacagacagtccgtaagattacagagtatgcggaagatgtatacggtgttgcaagtcacatctaaaaggagagatggaaatgaagtttaacacaaagattcttcatggaaaagcaggaagaaatacgccggacggaggaacacttccgggaatcagtcaggtaagtgcattttcttacgattccgcagaacatctcgaaaaagtatttggaaataaagcacctggatttgcttatacacgaatcggtaatccgactgtcgcagcatttgaacagagaatcaatgaattagaaggaggcgtgggcgcagttgcctgtgcctctggaatggcagccatcaccgcagcactgttaaatgtattaagtgctggagatgaaatcattgcaggaagcggattattcggaggaaccatcgacttattcaaggatttagaagcgtttggtattacgacacatttcattccacatattaccgtggaagacatcaagacggttttaaatccaaatatcaaggtggttttcggagaactgattggcaatccgggacttgatgtagtaaatatcaaagaagtaactgatttccttcatgaaaatggagtaccatttatcgcggatgccaccacggcaaccccttatctggtaaatgccttatcattaggagcagatgttgttattcattccagttcaaaatacatcaacggaagcggcaattccatcagcggaatcatcgtggatggtggaaagttcaaatgggataaagacagatatccggcaatgaaggaatacagcaaatacggaaagtttgcttatactgcaagacttcgaaacgatgtgtggagaaatatgggtgggtgtctcgcgccaatgaacgcttacctcaatattttagggcttgaaacactcggtattcgaatgaaagtactttgtcacaatgcactgacacttgcaaaggcattagaggaattggcaggaattacagtaaactatccgggactggaaagcagtccatacaaaccgcttgtcgatggacagttcggaggactgggaggtgccatcctcacaatccgggcaggttcaagagaaaaagcatttaaactgattaattctttaaaatatgcacatatcgcaaccaatatcggcgatttaagaacgttagtcattcatccatcatcaacgatttatctgcacagtaccaaagaagaacaggaacacgcaggggtatatgaggatacgattcgaatcagtgtcggcattgaagatgtggaagatttaattgcggactttacacaggcgatagaaaatatataatgtaattattcaaagctatataagcaaagaatcatcaaagttgtgatttgcaaatagcgttgaatggttacaaaaaatttagcagtatagaaatgaaaaaagggtatttcatttaattacaggaggacaaaatggcagtagattatgcaactctgaaaaagggcggatttatgcgccagaaacagaaaaataatttttctttaagacttcgtaccgtcggcggacatatgagtgcagagcagcttgcaaaggttgctgaagttgcagaaaaatacggtgaaggatatgtacatttaacatccagacagggtgtggagattcctttcattaagttagaccagattgaagaagtaaaaaatgcattagcagaaggggatgttgttccaggtgtatgtgggcctcgagtaagaaccgttactgcctgtcagggtgcagcaatctgtcagagcggctgtattgatacttacgcattggcaaaggaacttgatgagagatatttcggttacgaacttcctcataagttcaaattcggtatcacaggatgccagaataactgcttaaaagcagaggaaaatgacgtaggaatcaaaggtggaatgcaggttgcatgggtagaagataaatgtatccagtgtggtgtctgcgtaaaagcctgccgaaatgaagcaattactttagaagacggaaaaatcagtatcgacacaggaaaatgtaactactgcggacgatgtgtaaagtcctgtccagtagatgcttacgatgcacagccaggatatatcgtttcttttggtggaacattcggaaatcacatcagcaagggtgagacaattattccatttatcgaaagccacgaaaagttattaaaagtatgcgatgcagcattaaaattctttgaacagaacggaaaagcaggagagagactcaagttcacgatcgaccgtactggaaaagaggcatttgaaaaagcaatcaaggaggcctatgaaaatgagtgaaatacattttgacgaacaggtagatattactgatgttgtatgtcccgttacatttgtaaaagcaaaagtagcattagaagaaatggatgaaggacaggttttagccgtaaaaatgaatgatggcgagccagtacagaatgttccaagaagtatcaaagaagaaggacatcagatcttaaaattagatacaaacgatgatggaacttatactttattcgtaaagaaagttggagaataaagttacatataggaagttaaaagaataaaacaggaaaatcccagagtatatttgaaaaatgctttttaaaagataagcatttcataaagtaggaagtgcagattatttcttgatttttcagatatcttctgaaacaggagagcagttatggcagaaagattaaacaaagacagctttcaggaaaaggtgttaaatgcatcaggtcttgcaatcgcagacttctactctgacagttgtattccatgcaaaaagttatctccgatacttgcagatttggacgaaaaatatccagacgtatacatcggaaaagtaaatattgtttacgagcaggaactcatcgaagagtacagcgttatgtcctctccagtacttattttcttcaaaaacggagaagaggtagaccgaattataggggctgtaagtaaacataaaatcgaagaagcgattgaaaagaataagtagtaaagtatataataaaaactgataaaagacagaataaaacatatttataaaattagatataaagttatatatagcaatttgaatatatttataaaggcattgtaaagatgtatataataataaatagaatataaaagtttaaggtaaggccgatataataagacagatataattttataaatataaaaacagacataaatggaggatagaatcgtgaaaatcacagttgctggaaaagtaaaagaatatgaagatggattaaacatcacacagcttattgaaaaggaaaacgtagagacaccggaatatgttactgtatccgtaaacgatgaattcgttgaaagagtagattttgaaaaagccttaaaagacggtgacgaagtagaatttctgtatttcatgggaggtggaagataatgctatcaaacgagcagcttgaacgctactcccgtcatattatcctgaaggaagttggcgcaaaaggacagaagaaattattaaatgccaaagttttaattattggagccggtggacttggcgcaccagccgcaatgtatttagcagcagccggtgttggaacaatcggaatcgcagatgcagacgaagtagatttatctaacttacaaagacagatcattcattcaacacaggatgtaggtaaggcaaaagtacagtctgcaaaagagacaatggaagccattaacccagatgtaaaagtaattacataccgtactttcgtagactcagaatccatcatggacttaatcaaagactacgacttcatcattgatggaacagataacttccctgcaaaatttcttatcaacgatgcctgcgtaatggcgaaaaagccattttctcatgctggaatcatccgtttcaaaggccagctcatgacttacgtgccaggagaaggaccatgttatcgttgtgtattcaagaatccgcctccaaaggatgcagtaccaacctgtaagcaggcaggcgttatcggagcaatgggtggagtaatcggaagtcttcaggcaatggaagcagttaaatacatcctcggtgttggtgacttactgacaggctacctcttaacttatgatgcattaaagatggaatttagaaagattaaacttccagaacatacagaagattgtgctgtatgtggtgaccatccgacaatcacagagcttatcgattacgaacagacagaatgtgaggaaatctaatcatgcaggtaaagcttaaaaaagaagactttcaggcaatggcagcccatgccgttgcccacctgccggaagaagcctgcggactcatcgccggcgaaaaatccgacacagaacgagtaataaaaaaagtatattaccttacaaatattgaccatacaaacgaacacttctctttagatccaaaagagcagcttgcagcaatcaaagatatgagaaagaacggtttagaaccacttggaaactggcactcccatccggaaactccggcaagaccatctaaggaagatatccgcctcgcctttgattctgaggcaagttatcttattatgtcccttatggatcaggaaaatcctgtaatccatgctttccgagtaagagagggacaggtatctaaggatgagattgtaactatttaattcatttagaacagacgcccgcgaagaaatggtgtgcatcccgtcaagtagacaattaaaaaaatataaaatttttgtgttgcccggtcggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcgttaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagccttacttctgcccgcagtttttctacttccgtcatttcctctggggattttctctttccccgcttatcctgcagcccatccaccccgttttcttcatatcttatagtataacttctggcctgctgataagaaatgtgaaatttttttgctgtttccgaatagttatgggaatgttttatgcaatattgaacgatctcgacacgttcttcaaatgtagtttttctgcctttagtcatgattggtctgcctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgaccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccaaaaaccgatatcctatatttgtgactttagtcgcagcggtttaaatgctcgctttatacgctcgcatctaaaccttgctccgaggccacaaatataggatatcggttttcttcgcgggctgtctttgtctgtagttcgcttaatgaattaaaaagtaaaaaagttctttactttttttgtgattttggatacattattaataggagtactatcttaacctatctatcttaagttaagtatcgtagcattatgagatagaaatattgttaagtaagcaaaaattggaggaggaacatttgaatgagggcattatcagaaaaacgccttagcgactacatggcacaacagattgccgatgagattctttctggtcggattgtcggagggacgcagttaaaacaggaagaattagcagaagtatttggtgcttcgagaattccaatcagagaggcatttcaggtattagagggacagggattgattgtccgtctggcaacgagaagaatttacgcagtagaattatcggaagaacagattcagattatttatgaaatgatcggagatatcctcaaaaaagcagtagagaatttaaaaaatgaggataagggaaaagaagtgataactattctttcctctgatttatccacatcgaaacgtttcgatgaaatattattagactgtacggacaatgcatatctctcaaaactgctttatactgcttcggattgttatattcgttttgctgtatcctgtgggttgaatgagcaggagaacaaatgcagagaagagatgaaacagattattttagaagaaaatggtgtgaatctcgacagtatttcaggaagaaagaaaatattcaaaaaaatagatgtgtggatgaaggtactttcagatattgtaaatatagagaggggtaaaaataaatgatgggattaagaccaattaagatgccgtcagcgaaagaacgagtggcggcagaacttagaaaagcgattttatcaagacaaatgaaagaaggagaagtgctttctcttgaaagtgtggcatcacagcttaatgtgtctgcaatgccagtaagagaagcatttcagattcttgcccgcgatggattgattcagcttcggaaaaataaagcagcagttgttcttggtgtgacagaaacttatattaaagaacattatcagcttcgtgcaatcttagagggagcggcagcccgtctttgtgccgcaccagaagcagacatttcagagctggaagaaatatacgaagattcctgtaaagtattagagaacaaagacttttcacactacacagatattaatagagaattccataatgaaatctggacagctgcaggaaatggaaaaatgaaaaatatgatctcagaactttggaatggactttctatgggtaatatggtttctgaagaagactatgccaaagtttctgtaaaagaacatggagaaattttagaagcaatcaaagcacatgatggagatgcggcagaagcagccatgaaggaacatataatgcgaagcagagatgatatgctgacttattataattaggggtgccgcagacaggagacgcccgctgaaagataaatagaccatatttgtggctttagtcgcggcaggttgaatgttcgcgtggaagcgctcgcatccaacctttgctccgaggccacaaatatggtctatttatctttcagcgggctgtctttggagggtcgaggtgttaattataatattgaggtaatttgtgtatgagagtcgtagactccgactttcttccccaaatcttccccagattctttattttggttcgtctgtccccactaccccacaaatcaatcctagtgcattctgcacaaaaaaatagtcacaactttattgtatttgccgaaatgatgcaaatggagcaaaaaatagttgactttttctcaataaaggtatatcttagaatcaagatttggatacaaaatcaaatatcaaaaatcataaatcagaaacgcaaaagcaaaacattaagtaaagaaattgggattttcatttactgggtatgggaggctggaaagggtaagaggatttatgataaaagcaaaacgtaagacgaatctaacaaatgaggaggtagagagatgagtcagataacaatcacgttacttttcttgctgttcgcgattgtcatgtttatgtgggagaagattccactgggactgacatccatgattgtatgtgtcggactggtagttaccggtgtacttgaatggcagacagcgttcgcaggatttatcgacagcaacgttatcttgtttgtagcaatgtttatcgtaggaggggcattgtttgaaacaggaatggccaacaagattggcggaattgttactcattttgcaaaaacagaaagacagcttatcgtagcgattatggttatcgtaggtgtgatgagtggattcctttcaaacacaggaaccgcagcaatcctgattccggtagttattggaattgcagcgaagtcagggtattcccgttccagattgttaatgcctttggtttttgcagcagcgatgggaggtaacctcacattgattggtgctcctggaaacatgattgcacagtcaggtatggaaggaattggtcttaagtttggattctttgattatgccaaagttggtgttccgattttaattgtaggaattatttactttgcatttatcggatacaagtttcttccgaataaagaaggaagcgacgaaggaatctttgatgagtcaaaggattttagccatgtaccaaaatggaaacagtacctttccttagtaattctgctacttaccttagtaggaatgatatttgaggaacagcttggtatcaagctttgtgtcatcggatgtatgggagcgttagctttaatgattacaggggtaatcagtgagaaagatgcactggcatctattgatttaaaaacgattttcctttttggaggaacgctttctttagcagctgcattagagcaaacaggagcaggagaacttattgcagaaaaggtaatcggaatgcttggcgataacccatctccatatgtacttacatttgtaatctttatgctctgctgtgtaatgacgaacttcatgtccaacacagcgacaacagccctgatggttccaattggaatttccattgcacagggaatgggtgcagatccaagtgccgtattgatggcatgtgtcattggtggttcctgcgcatatgcaacaccaatcggaatgccggctaacacaatggttgtaacagcaggtggctatacatttaaagattatgccaaagctggtgtgccaatgattttagtggcaacggtagtaagtatgatacttcttccgattttctatccatttttcccaggatagagagccggttaagcaggccgggttgctccggccgaataaattaaagcagaacttattaatgaaaatgtatacggttaatctttcattcattcacatatttaaatcccgttgaccgtcgggtaaattaataggaggatttctaaatgtctaaagaagaacaggtaacacaacttacggaacatatggctaagtttattgctcatgttgcaaagaaacttccagatgatgttattgcaaaactggaggagcttcgtgataaagaagacagccctctttccaaaacaatctatgatactatgtttaaaaatcaggaactggcggtaaagctgaatcgtccaagttgtcaggataccggagtattacagttctgggtaaaatgtggtacaaagttcccattaatcggagagcttgaagcactcttaaaagatgctgttgtaaaagcaacatttgaagcaccacttcgtcataacagtgtagaaacatttgatgagtacaatacaggtaagaatgttggaaaaggaacaccaactgtattctgggacatcgttcctgattcagacgaatgtgaaatttacacatacatggctggtggcggatgcacccttccaggaaaagcaatggttcttatgccaggtgaaggatacgaaggagtaacaaagttcgttatggatgttatgacaacatacggattaaatgcctgtcctccattattagtaggtgtaggtgtagcaacttctgtagaaacagcagcccttctttctaaaaaggctttaatgcgtccaatcggttctcacaatgataatgagagagcagctaagatggaagcattattagaagacggaattaatgctatcggattaggacctcagggtatgggtggaaaatactccgtaatgggagtaaatatcgaaaatacagcccgtcatccatccgcaatcggtgtagccgtaaatgtaggatgctggagtcacagaagaggacacattgtatttgacaaggatttaaattataaaattacaacacatacgggggtagagttataatggtagaagtaaaagatggaaaaaagattttaacaacaccaatttcagcagaagatttaaaaggcattaaaatcggagatatcatttatttaaatggaagcatgacaacctgtcgtgatgtagctcaccgtcgtttagtagaagaaggaagagaacttcctgtagatgtaagaaataatgctattttccatgcaggaccaattatccgtcctttagaaaatgataagtttgagatggtatccgtaggaccaacaaccagtatgcgtatggaaaaatttgaatatgaattcgtaaaagaaactggtgtacgtgtgatcatcggaaaaggtggtatgaaagaaaatacagaacgtgcctgcaaagactttggagcaatccactgtgtattcccagcaggaaacgctgtagtagccgcaacagaagtagaagaaatcgtaagagcagaatggcgtgatcttggaatgccagaaaccttatggaactgccgcgtaaaagaatttggtcctttaatcgtatccatcgatccagaaggaaacaacttctttgagcagcagaaagtagaatataacaaacgtaaagatgaacagattaagaaaatctccgcacaggtaggattcattaaataaattcaataaactatcaacaaaccagaatatatttgaaaaattattactgtgatatgaacacctcgatttataatatatttacagaaaacatttttcaaatacattttaatgaattataggatactgtgcaaagaatccgaaatctggaaatttgaatatatgtcggccggcaggcataaacctgccggcatataaagatgatacaagataatcaagatttacaatcaaataacaaaaaaataactaattccaaataacgtaaaaaccacaagtaaaattcccctaagttagaaattaagtattataaaaaacatctgccgatagttttactagaactatcggcagatgtttttttaaataaaattaatattgtattaagaatttttagttgatttctcatccattctagagcgtgtttgaaaaatcattcctacaatctgcacgctctagcatataataaaaccagctaagaaatgtggtgaatttcaggcatgagcaaaatgaaaaccccggaagtgtgtgtgacttccggggttttctattccgtttatgtaaggtggtttacgcctttaggctgttactgtctgtcgtttctatcatccaaatatatcaaaataattacctatagaaaaaatctaaaatttaatagaattttcctatagatttattttgttacatttacttgttgtagcttttttcctgtggtataattacttagctgtttaatgtgtgaaagttactatattcgaagtcagtttttataggctcaggaacatttcagtgattattcagagatatttaatttagtaatatttccgtttagttgattttgaatatggatacatttaatagctggaaatttttattagaccaaagaggggagcagcaacatgactcgtttagaaaagttaagaaagagactgggtcagtgtgacgagatacttttagatgccatactgatgagacatcatattattaaagatattatggcttacaaagaagagaatggccttaacattcttgacccggaacaggaagaaagacagaaagaatggctcgacggtcgtttagaggacgagagcaatgcaagtgaagtatgggatattttccatgcgatcggtaaagcaagtaagcagatgcaggcaagaaagcttttcgattacaatatcgtacttatcggatttatgggtgctggaaagacaagtatttccgaatatttaaaaacattgtttgcaatggacgttattgagatggatcagattatcgcagagagagaaggaatgagtattccagatatctttgaggttcatggtgagcagtacttccgtgatttagagaccaatcttcttattgagatgcagtcaagaaagaatgttgtaatctcctgtggtggaggaactccactgcgtgaatgtaacgttgtagagatgaagaagaacggacgagttgtattacttaccgcttcaccggaaactattttcgacagagtaaaggatagtcatgaccgtccagtcatcgagaacaacaaaaatgttccgttcatcgctgatttaatggaaaagagacgtgcaaaatatgaggcagcggccgatatcattatcaatacagatggcaagagccttatcgaagtatgtgaagaactcgtccagcagttattagctatggatgagaataaataattatatattaagattttaaagaaaaagaaagagggtatgtatcatggcaaaagttgacattaatacaaagatgattactttacttggtgacccattaaagcagtcatttgcagcacagatgcagaattgtggttatgaagccgcaggattaaatatgatttatttctacacagaggtaaataatgaacatcttgcagacgtagttaacggtatccgttacatgaactttgcaggttttgcagtaacaaagccaaacaaagtaaaagttcttgagtaccttgatgagctggacccattatgcgagaagatgggagcaagtaacacagttgttaaaactccggaaggtaaattagttggatataacacagacggaattggtttcatcagatctatggaaagagatggaaatgttaagattgatgagaatatttacttctgtatcggtagtggtggagcaggtcgtgctatgtgttctgcacttgcttactacggagcaaagaagatctacatcacagacgtatttgaagaatccagtaaatctttagtggaagatatcaataagaactttgcaccagttgcagaattctgcccagcaggtgacttttctaaagtaaaagaagctacagttgtattaaatgccagtggaatcggaatgggcagccatatcggagaaaacccacttccaaaagaattcatcagcaaagatcagttctattttgatgcttgctacaacccagcaaaaactcagttcttattagacgctgaagaagctggagcaactatcttaaacggtcttggaatgtctctctaccagggagctgcccagattgaatattggacaggtcaggaacctccaatcgaagcaatgcgtcagaaattattagatatcatctctgagaaataatagaataaaaaagtagtatactgtcaattacctgcggctgctgcatcaatcaatagactttaatttatcgtttgttgtatgaaagtcgtgggtttttgactataagaatgtaaaaatataaataaacttattattagagaaaggattttattatgaacccagtagtagtaagaaatgtagcaatcggagaaggaatccctaaaatatgtgtacctatcgttggaaaaacaagagaagaaatcttagaagctgcaaagaatatccttccaatcggagcagacgttgtagagtggcgtgtagactggtacgaagacatcttcgattttgaaaaagtagaagaaacagcgaaacagttaagagaagtacttggtgaaatgccaatcctttttacattccgtacttctaaagaaggtggagaaaaggcaattgaaactccagtttatgtagaattaaaccagaaaatcagcgcaacaggctatgttgacctcgtagatatggaagcatttacaggcgatgatgcagtaaaagctgtaatagaagaagcacacaaacatggtgtaaaagtagtagcatccaaccatgacttcgacaagacaccagcaaaatctgatatcatctacagactccgcaaaatgcaggaacttggagcagatatccctaaaatcgctgtaatgccacagaacaaaaaggacgtactcactcttcttgcagcaacagaagagatggtaaataactacgctgaccgtccaattattacaatgtctatggcagcaacaggtgtaatcagccgtgtatgcggtgaagtatttggttctgctctcacattcggtgcagtaggaaaagcttccgcaccaggacagatgggagcaggggaattaaaagaaatgctcacaacattacatgcttctctgtaaatcctgatttgcgcagcaaaggagacgctttcaaagagagccgataccctatatttgtgactttagtcgctgcaggttgaatgttcgcttaaccgcttgcatccaacctttgctccgaggccacaaatatagggtatcggctctctttggaagctgtttgttggctgcccatgcaaatgcaggatttattttgagaaagatttgagggaggcttcagacagttgtgaccttacggggagttggtattctgatatgccattataacaatagtttatgtgtcaatccaacaggattttattccccgaatattctatatctcctgtcttctttctcaaatcccccaactgatttttcgagctgccaacaagcagaactccagaagctaaataaagcatatttgtggcctcggagcaagatttggatacgagcgtgtataagcgagtattcaaaccgccgcgactaaagtcacaaatatgctttatttagcttctggagttcgtctgccttgcagcctcacaaatcagaatttatttgggagcgtctcctttgcctgcggcaaatcagaattcttccgaaaatctttgtaaattcactatttgacattgcatagtacctagtataatatagtatcaacaggaaaggagcgaatcaatgaatgcacagtttaagaaaggggttctggagctgatcgttcttgcagcagtagagcaaaaagatatgtatggatatgagctggttgcagaagtttcaaaagtagtgaatgtaaaggaaggaaccatttatcctattttgaagcgactgacgaatgaacattattttgagacatacttaagagaatccacagaaggaccaccaagaaagtattatcatttgactgctgcggggattcttcatttaagagaattggagaaggagtgggaagaattttcccggaatgtgaataagtttttaaaggagagataaaggatgacaaaaaggaagtttttaaaagagctggaagataggctccagatgcttgatgaaaaagagcggaaagatatgatagaggaatattcacaacatatcagtatgtgcatgaaaagtgggatgaaagaagaagaagcgattgaggattttggagatatggatgatttgattgctgagattcttgaagcgtatcatctggatccggaatatgaagtaaagagcagggaaagaagcggaaaaacaggaattgcagatttattgccaaaagattttttcaagaaaaaaacgaagatagctaaagccggtaataaaagcaatgtcaatgatggaaataataaaagtaatcctagaaagaatagaagagtagaaggaacaaaacgctttaaggaagaacaaggacgaaaaatagaaaatataacgagtaaagctgtgaaaacgggtagtaatgccgtttcatggagctgggataagattaaaaaattcttttttatttttataaaaatagtattagttttcctggcacttccggcagtattttttgatctggcagggttattcgggttgggaatattaggtgttatggcatttcagggatatccggttataggatgcgtcatcatagcatttggagcagttttaagcatgacagcatatattctttttttatttacctatgtattaggaggaagaggagcaaaagcatgagttttagaaaaatactagtaggaatttttatggtagggattatctgttgcggaattggagcaggagtaacatttcaggagtattcttcatttaaatatatgggagaaaaaagaatagggagcaataaaatcgcagaaaaaacactgactgagaatttgtatacagataaaacgaagaagttaaatacatcatttatagcatacaataatgaaaatgagaatatagagctaaaaacatcaaaatctgttcctaaagataaaatacaaatcaaagtacgttatgatgcagataatgtaaaagatatacatattgataagaatttatataatgatgatgagtatataggggacgatatatatattgatgatgactacgatgaaaacagtatggataatgtggcgttggaaaatatgacacaaacagatgaaagtgaatctgcacagaagaatccaacaagtcaggaattttttattagtgcagtgggacgtatgtctgatatagaatatgttctcagttacaaagatgaaattttgaaaaacatcaaagaaagaaaaatttacaactatgtttatccacaaattatttctgtagagattacggtcaatccagagaataaaaatctaatgaaaatataagtcctggtttgcgtagcaaaacaaacagacgacgctacagaagcatagcaattaaattttagtggactgatactaaaatagatgtgaaaagcactgaattttagcatattttattgagattagcatgagaaatgctgtagtggaacaagatcgatttgcatatgtattagagcgtgtttgaaacttagtttattattgtaacacaatgataacagtttgaatgtcagtcctttcaagtttgatttcttaaaaagtcacagccgtctgaagcctccctcaaatctcttcaacatgaattctgattttcctccaatcgccaaagacagctccccaagagagaccataccctatatttgtgacctcggagcaaaggttggatgtaagcggttaagcgaacattcaacctgcagcgactaaagtcgcaaatatagggtatggtctctcttggggagcgtctctttgcctgcggcaaatcaggatttctaggaaacaaatggcagtacatatgttacccaaagatgactaagtggcattaccagcaccattgccggtatcatgtcggctatcgggaattcttttactttcatcattcgaaagccagttgcgacaagaagcacgccaccacaggctttgaaatcacaaatcatagtttcagtgcagaacggataaatcgcacctgcaagtaagaaaagtaccatgaatatgataaactgcggtactgcgattacgcaggtaacaactccaagaatacaggcaaagattaaagcagtggcaagatcaagtacggtttttgctaaaagaatactgtggtccccagtcattcccgcagtaatacttccgtaaattcctgtaccacttgcacagaataatacgatagcagtaactaatacactctggtattctgcatcttttttactttgtccgggaatgattttagaaatgattttttccattctcattcccattttttgtgtaagatttccgagatgaataatcagcccgattacggttcctaaaataacagaaagaataacggcaggcatatttttcatcagggaaatagaactgatacccatagtcatcgcacaggcaccaaaaactaagttgagatttgtcttgaaagattcagttagtcgcggtccgataaaagaaccagcaattccaccaatgataattccaagacagtttgcaataactccgattggcataaagattctcctttttgaaatagtaattaatgtggctaacagacgaaaacagggaaatcatagcattgcatctgtgactttagtcgcagcggtttgaatgttcgcttaagcgctcgcatccaaaccttgctccgaggccacagatgcaatgctatgatttccctgttttctgactttggatgtaagaaaattactataatccagccaaagtcagaacccaggagactaaataatccataaatatgacctcggagcaagtgttggatatgagcgtttaagcgaatattcaacacgccgcgactaaagtcacatttatggattatttagtttcccgggttcgtctgttcatcttaatgaattaaaccaaacccattatactagtatggaacgttttctgcaacatctactggtggttcgaatccttcttcttctctttttgcaaggaattctttcagtttctgagctggcatatcaagtcctgtatacagtttgaatgcaccggctccctgccataaaagcataccttttccaccgataacgttctcttctttacatccatttgctacagcgtcagccataagttttgttactagtggatggtaaataacatcgtatataaccatgtcttcgtggaatacgctcatatctgtaacaagggactgtccgtcaagggcaggagccattcctacgcaggttccgttaataagaatgtcacattctcttatcttatcatgcataagatctgtgtcacttaatgaatggaactctaacttacattttactccatcatccatcattttctggccgataccagcaacgtggtcaagaccttctttacttctgttgaatacagtgatggactttgctccgtctaaagcacactgtaccatgatagcggtagcagctccacctgcaccaaataaaacaatatctttatctacgattgatacgttatgatcttttaaatctaaaacaacacccataccgtctgtgatatgacctgttaaaactccattatcattaacaatagtatttacagcaccaacgaatcttgcagcatcagataacttatccatattgcggcatacttcctgcttacatggcatagtaacgttggcaccacgcatgttcagtcgtctcattgcagctaaggaatcttttacctgggatgcatcagtatcaaaggcaagataagcacaatcaattccgtaataatcaaagcagaagttatacataatcggtgagccggaatgtttgattggggtgccgaatacacctaataatcttgttttgcctgaaattcttgtatccataataattcctccataaatttgaaaactagcacctgagaaattaacactttaaagcattcaagtgcttggttgttaaaataccatctttcgacaggaatgtcaagagaaaatacgcaatttaattaaaaattctgacttgccgcaggcaaaggagacgctcccaaagagagaccataccctatatttgtgactttagtcgctgcaggttgaatgttcgcttaaccgcttacatccaacctttgctccgaggtcacaaatatagggtatggtctctctttgggagctgtctttggcgattggaggaaaatcagaattcatgttggagagatttgaggattccccgaaaggatgtgatttttcaaacacgctttagtacatcaacaaatcaatgaaatattaaggattgacacacaaaatattattataatatcacagcaattttacaataataagccagagttcctatttcttctgtccccatccccaaattttttcaactgatttgtaggactgaaatacacagaaccctcctcccctgtaatctataaaaatacttcgtttcactgcgtccaagctgctcatccgcaacttgaacttgctctaaggcgcatttttatagattacaggggaggagggttcgtctgtttatttctccaactctacaaatcaggatttttaaccaaagttgtattctttgtttagcttactctgttcaataacatattttttaaattcctcaatcagcggtggatgatatacatctttaaggattgccatatagaagtacctcttataagaaggctgtgtcaatttcagcacttttacatccacatggttaagcccgtcaaactttggagcaatcataataccgaagcctttggaaacaaaaccggcaccgacaagatcttcttcaatctcgcaaagaatatccgggtatgcattgatacttttgaataagtcatcaataatctggcgcagtccgcttttatgccggaagataatctgctgataggccagggtctcttttaaagttacactgtctttggcggcaagaggatggtcttttggaacaatgacaacaagttcttgagtcgcgatagggataaattcgaccattggactattatttaacttagagcaaaaaaccatgtcgtattctctgtctataagactgcggaccagatcgacagagagcccatgttcacaactgaaattaaaccagatatttttatctggatgaagatcaagaaagttttttacggtagttggaacatagtctgttccgagtgtacggagaaagccgatattgatttcaccttcaccgtttgccactaatttgatgtctcttactgcattatctaagtttgcgagaatttcctttacattagaataaaatgccttaccatattttgtcagtacaatgttacgcccacgcttttcaaagagctgtatgcccagttcgctctccaatgtagaaatagcgtagcttaagctgggctgtgtgatagaaagaatctcagcggccttgctgtaatgttctgttctggcaagtgtttcaaaataacgtaagtgaaataagttcattgaaaaacccccttcaataaaagtattgtttaaagatttcagtattatgttagattcgttttgtttatagaatgtagtctgtaaaaacagattcataaaatcaaaattaaagtacaaaaaatgacgtatcaaaatgatatatctgattgtgggatattaaaatcatattaccagatcattttacttaaatttaattagaagtattgccataaatttttaagaaattcaccttaaaaattcctatgttttaccttaccataaatgataaaaaaaatctatgaatttacgaatattctcgattggttttattgaataaaacgagttataatctaagtaacttaaaaagttaaaaaaataacaagtaaattttttaaagcaaaattatatttttttcaaatgagaaggaggacatatcatgtcaaaagaatttcctattaccgttagttcatggacacttggagaccagtgcaaatttgaggagcgtgtaaaagcagcaaaggaagcaggatacgatggaatcggtcttcgtgctgagacttatgtagatgcattaaacgaaggacttcacgatgaagatatccttgcaattcttgaaaaatatgatatgaaggttactgaagtagaatacatcgtacagtgggctgaggatgctcgttcttatgagcagaaatacaaagagcagatgtgcttccatatgtgtgaactcttcaacgtaggtcacatcaactgtggattaatggaagattactctgtagaacatacagctcagaaattaaaagagttatgtcagagagcaggcaaattagtaatcggtgttgagccaatgccatacagcggaatccctaacatggaaaaaggatgggctgttgtaaaaggttctggatgtgacaatgcgaagttaatcatggatacatggcactgggtaagagcaaaccagccaatcgatcttgatgtaattaaagatatcccagcagataagatcgtttctattcagatcaacgacgtttgggatcgtccatacgctaagagcatcttaagagatgagtctatgcatgatcgtctcgctcctggaacaggaattggatgtacagcagacttcgttaagatggtacgtgaaaaaggtattgagccaaaagcaatcggtgttgaagtaatcagtgatgctatccttgctaaaggtgttgcagaagctgcaaaacatacatttgataatacaaagaaagttcttgagcaggtttggccagaagtactttaatcttcaattatttacttgaattatataattaacttgtcaaaagctaaaatgaaataatagaccgcagcccgcaggttagaggctgcggcgcggtcatgtgaataattaggaaggggtaaattatgaagtttgaaaatatgttttcaccaattcagattggacctatggaagtaaagaaccgttttgtagtacctccaatgggtaacaactttgcaaacacagacggaacaatgagcgatcagtctgttgcttattacggtgcacgtgcaaagggtggatttggtttaattacacttgaggctacagttgttcataaaggagcaaagggtggtcctagaaaaccttgtttatatgatgattctgcaattcctagcttcaagaaagtaattgatgcctgccatgcagaaggagctaaagtttccattcagttacagaacgctggaccagaaggtaacgcaaagaatgctggcgcaccaatccaggcagctacagcagttacatctgcagatggaagagatattccagaagcagttacaacagagcaggtttatgaattagcaagaggatatggagaggctgcaagaagagcaatggaagctggtgcagatgctgtagaaattcatatggcacatggttaccttgtaaattctttcatgtctccaagaacaaataaacgtgtcgatgagtttggtggttctttcgagaacagaatgcgtttctcaactctcatcattgatgaagttaagaaagcaacacagggcaagattgctgtactcgctcgtatcaacagcacagaggatatgttcggtggacttgacaaccatgatatgtgtgcaatcgcaacttatttagagtcttgcggattagatgcacttcatgtatctcgtgccgttcacttaaaagacgaatatatgtgggcacctacaggtattcacggtggattctctgctgaatatgtagcaaacattaagaaatgtgtatccatccctgttatcacagttggacgttacacagagccacagttcgctgaggtaatggttcgtacaggtaatgcagacttagttgcatttggccgtcagtctcttgcagacccagctatgcctaagaaagcatttgaagacagattagaagacatgacaccatgtatcgcttgtttacagggttgtgttgctaacatgtatgctggtaagccaatctgctgtttaacaaacccagttcttggccgtgagagcgaaggaatgaaagaagcagaaactaagaagaagatttatgtaattggtggtggccctgctggtatgtgtgcagcatttactgcagcaagaagaggacatgacgttacattatttgaagcaagcgacgtactcggtggaaatatgagacttgctgcttacccacctggaaaaggtgatatcacaaacatgatcagaagttacatcacaaaatgtgaaaaatctggtgtaaagattgttcttaatacagaagtaacagcagatcttattaagaaagatgctccagatgcagttatcgtagcaactggttctgaaacgcttgtacttccattcatcaaaggtatcacagctcctgaaattgttcatggaggagactgcttatctggtaaacgtccggtaggacataaagtacttgttgtaggtggtggtatggtaggtgctgaaacagcagagttccttgcagaaaaaggacatgatgtttctatcatcgaaatgagagatgcaatcggaccagacgtaatccacgaacatagagtattccttatggaaggtcttaaagaatatgacgttcatcagtatgtagatgcagcagtatctgagatttaccctgatggcgtaagctacaagaatgcagccgacaaatctgatgatacagtttatgaattaagaggatttgacactgttgttctttcaatgggatatgtttccaaatatacacatcgtgaaggtcaggaagttgtttacgatttcgttgacgaattaaaagctatctgtccagaagtacacgtagttggtgatgctatcagagctcgtcgtgctttagacgcaacaaaagaagcttatgatgttgcattaaatatttaatcgtatcagacataaatatacaaactgatatcagatgtattcttggaatcttaatctgtctgctgatgaattttgcctggtcgggcaggaaagattctgagagtgcatcagcaattatggagggaataacaaatggaaagacgtattaacggacacacaggacttttagcactgtttggaacacctgtaggacattcaggatcacctgcaatgtacaacttcagctttcagcatgacggacttgactatgcatatatggcatttgatgtaaatgtagagcagatgccagctgtatttgacagcattcgcttattcaagatgcgtggtggtaactttacaatgccatgtaagaacattgcagcagagttagttgataaattatctcctgcagcagagattatcggagcttgtaacgtattcgttaacgatgacggagtaatcacaggacacatcacagacggtgttggtttcgtaaagaaccttgaagttaatggtgttgacgttaaaggtaagaaaactgttgttcttggagcgggcggagctgctacagcaattcaggtacagcttgcattagacggagcttctgaagttgcaatcttcaacattgatgacgagttctacgcaagagcagagtctacaaaagaaaaacttgcaacacgctgcccagaatgtaaagtaactgttgagcatctcgaagacaaagaagctcttgcagcagcagtaaacaatgcagatatcgtaatcaatgctacaatcatgggaatgaaacctcacgaagacgtaacattaatcgataaatctttattccgcaaagacttagttgttgctgatacagtttacaatcctgaaaaaactaagatgattcttgaagctgaagaagctggatgtcaggcaatcggtggaaaaggaatgctcttatatcagggtgttgttaactacagtctgtttacaggaaaagatttcccaatcgaggaatatcagaaattccaggcagaacaggcaaaatagttcaaattaaatgaatgccagagggggagaggaaaatcacctcttctggcaggatgttaattagtagcacaaaactacatttaaaatttcagaggagaaaagtatgaaagcgaaaaaatatatctggtcaatgatctgtgtgtacatggcttatttgacacacggtatgcaggcacttattttttcacagaatcaggtaaactttgcaactaaatggggatttgatatgactgatccttcttctgcagcttatgcagcgggtgttgcagcagtttccacagcaatcgcatggactggatttggtaaattcatttctgtatggattggtggagagatttctgaccgtgtcggccgtaagaagttaatgattggtggagcaattctttatatcatctgcttcgcaacaatgttcgtaacaaacaatgcaacagttgcagctatcactggtttattaggtggtatcgctacatctgggttctgggatgcatctggatatccagcagtacaggaagcatatcctgcagcaccaggttccgcattaattatgattaagttcttcgtagctttatcaagtatcttctacccactgatctgcgtacagacagcagcagcaggtaactggaagatcaacattgtaattcctttagtattatcttgtgttgtattagtatttgcatgtatcgcaagattcgtttatgatgatgaaaaagcagcaaacgctggttcaggaagcgacaagagagctgaccaggctgaaatcgatgcagcaaaagcaagacagcttgttgcacctggaaagtttacagcattcctcacatatttctatgcattcttagtaatggcagttatgtatggtgctcagcagtatacaaaggctttcggtcttgcatactgtggacttagtgaaatgcaggcagcatctatgacaacaatgtatcaggttggttctatcgttgccgtagcattctgggctgtaatgatgagtaagttaaaatggcatccattaaaagtgttaatcgttgatgcggttatcacagcaggatcacttttagcagtacttttagtacatcaggtagcaatcgtttatatcgcaatcttaattcttggatttggttgtgcaggcggtgctttacagacaggtctttctgtattacaggaattcgtacctggaccaaaaggacgtaacacaggtatctactatacattcatgggtgctgcttcttatcttatgcctgtaattgtagcaaaattaacagtcatttccggtgaaagcaaagcggtatacacattaatgactcttatgtttatcttagcagttgttcaggtagtagcaacactgtacctcatcttaagatacaagaaggtatttggaactactccattagcaaaagcggaataaagtttaagataaatagctaaacagcgattttaaagtaattattttaaatccttatgaagttgttttaaatagttatgggaatttagatgattacaactaaaaataaatggtaatcagcctgtatatggtttatactatatacaggctcaccatgtttttagctgtttatttttttaatattgttagttaaaaaataaacaaaaatctattgaaacctataaattcatagaatatatctataagtactaaccgatgcacaaaaggggagtcagaacaaacgataaatttgttatttgtaagtattttagaagatatctatggtaaatctgttgtagtaatacactgctgtttcaattttattttctgaaaaacagatgtagactgaaatagatttaaacaaaggataattttgttttttggtgtgttagtacacaagtattagaagaggagatattatgaaggtattaaagtggctggataacaatttggaacaggccatactcctgattttattgtgtggaatgacaatcgttatgggagggcagatcattgccagatatgctttttcagcttccctgtcctggtctgaggaaatcaccagatatatgtttattatttccggttttatcagtgccagttattgtattaaacacggattatccgttaagattgaccagttagtaggtatgcttccgggcaaaggagtacattatatgcggctggtaagttatcttatacagttactcttttttgcttatctggttccttttgcatggaaatatgtaaaggcaggaatggcaagtggacagctaagtccggcttgtggaattccaatgtatctgattcaatcattcacagtaatcagttttgttttatgctgtatccgtctgatccagaaatttatacagcgagttgaaatcatcacaggaaaaagagaagcggaggagaaataaagaatgtcaccattagtagtatttatattattctttgtatttttattaatagcgattcctatctctgtatcacttggtctggttgcagtattaccgggagtatttgatccgtcttttacagcgagtgcttcctatgttatccgttctatgtttggtggaatcgacagtttcccactccttgcagtaccgatgtttattttatccggtatcattatggcaagaggtggaatctcaaaaagactttttgatttattttcatttttcattggaaaacgtacagcaggtctgccatgtgcggcagtaataacctgtctgttttacggagccatctccggttcaggaattgccacagttgccgctgtgggtagtatgacaattccgctgttagtagaacttggctacgataaaaagttctgtactgccttagttgcagtagcaggaagtcttggtgttattattccgccaagtatcccattcatcatgtatggtatggcatctggagcttctgtaagtgacattttccttgcaggtatcgttccaggagttcttatcggactgcttttaatggtatatgctgtattttactgtaagaaacatggagaagataaagaaaagattaatgcaaagattgatgcccttcatgaacagggactctggaaagtatttaagagcagtttctttgcagtactttccccagtcatcatccttggctgtatttattctggtgttgcttctcctacagaggcagccgttatctctgtattctactcactgattgtcagtatttttatttacaaatcacttccgattaagaaagtttatgatgtatttgtagaagcagtaagaacatatgcgccaatcttatttattttggcagcatccatagcattctccagagtacttacactgatgcaggttccacagcttatcagtggatggattcttgctcattttacaagtaaggttgttgtattaattgtaatcaaccttgtattattacttgtaggtatggttatggatactactcctgccatccttatccttacaccaatccttcttccaattgtagagggctttggaatgaacccaattcattttggtgttatgatggttgtaaacttagcgattggttttgttacaccaccaatcggtgtaaaccttttcgtagcaagttctcttactgatattcctgttgtggatatcgcaaaaagagcaatgccgctcattggtttctttttaattgcattgttacttattacatttattccacagattagtctgtgtctgctttaggataggaaaggagaagcaaaatgaaaggaaaatttacaagcgttatccttgcagttgttcttgtcgttattactgtaggaactgtattcttcggatattctaaggcaagtggtaaggcagcaaaatcaagcgtagaaggggagcagagatatgcatggcctctggcaacctgtagtacagaagatactattacacatatttttgcgacacagtttgcaaaagaagtagaaaaactcagtgatggtaaaatgaaaatcaatgtttacccacagagtacattaggtggtgaccgagaactcatggagagctgtaaagacggagacatcccattcgttgtacagtctccggcaccacaggtaagtttcatgccgcagctttgtgtatttgatactccgtgtgtatttgagaacattgatgatgcacgtaaagcgattgataatgctgatttccagaaagaaattcagaaaatttataaaggtgcaggctatgatttacttggaatcgcagaccagtgttttcgtgtaatgaccagcgccaaaccatttacaggaatagaaagcttcaaagggcagaaaatccgtacaatggagaacgcatatcatcttcagttctggaaacagatgggtgctaatccaactccaatgagcttctccgaagtatacatcggactccagcagggaacaatcgatgcccaggagaatgcctacgagattatcgtaagtgcaaaactctacgaacagcagaaatatttaatcagtaccaatgccgtacctgattacacaacattgattgtcagtgatgaattctatcagggactgacaaaagaacagcagaagattattgatcaggctgcagaaacagcccaagaaaaagcccgtgaatccgccgatgaccgtcgtgtacagcggcagaaggttcttgaagacgaaggtatgcagattgtagatgtagaccagaaaacctggaaacaaatgcaggaaaaatgccagccggtatacgattccatccgtaaacaggcaggagataagcttgtagacctttatatgggtaaatagataaataggaatttgccgcaggcaagggagacgccctcttttgataaataaagcatatttgtgactttagtcgctgcaggttgaatgttcgcgtaaacgcgctcacatccaacccttgctccgaggccacaaatatgctttatttatcaaaagagggctgtattttggctggggaggaaattgctatttattatacatctattccacattctcaaatatttcttctaatgccattgttatatgtggaaagtctcgtaacgtgattattgtatcagcgttatacccttcttcttccgtatcgtcctgtaatatataaaaatactttaatacatatgcggaatcctccagataatatatttctactgcccgttcttttggtgacacgatccaatattcacttacgcctgcattctggtatatgtctttcttgatagtcttatcatttaaggcagtcgcaggcgataaagtctctacaataaaacgtggaacacctgtataagcactttcttttaaatgtttacggtcataaataaccataatatcaggaataacataatcatcgttctcctctacatggtacctgtaatcaagattctccataaaagtaagacacaaactacctttaaatccttctcgtaactttccatatatatttccatttactatactatggcgataattagcagaaggagacatattatatactacaccatttattttctcctgcttagtataatcttcttttaactttggcatgtaatccctcctctcatgatatatatcttttgtttatataatagtatatcagttttataagactctgcacaagagcatctttttggggttcaactgtatagctggtcaagtcacaaatacggattatttgattctcaggcttcatccgtttcgtcagctttactcatctaagaaatgaagtttctgtgaactgtggtaaagatattgacagtgagggtgtttttttatataataaacctatcaaaatagtaggttgaaactgttatgatagaataaaatctattgtaacagtttttttctgcttaaaagagttttaatttcgcttttatagactttaattttgaacatgaagaaaatgattataatgattatttagattgagaaatttaaagattatttttgcagagtttacttattggagtattttcaaacataattcagaaaggagaaaatcatggaacgcagacaattatatattgacgggatgacttgtataaattgtcagaagaggatagagaattgtttgagaaaaagagtggagattaaagaagcagaggtttcctatgaaacagggacggcagagattttatatgatgcgaataaaattacgttgcaggaaattattcgtatcataaatggtttaggatatgatgcgaaggctgagccaaattcccgaaaagatatcgcattacgggcagtgcaggagctgactataattttggcagtattcttccttttacagcattttggaatactgaatcgacttgcaccagattctctggcagatgcaagtatgagttatggaatgctttttgtgatagggatggttacttcggtacattgtattgctatgtgtggtgggattaacttatcgcagacattacagagagaggcatcgaaagatattagtcgaaaaatgttcaaaaatactttgatgtacaatatgggacgagttgtttcatatacagtcattggaggagtacttggtgcaataggaggtctgaccggaattggtggcagtctgcaatcatcttctttattacagggaagtttaaaattatttgcaggaatcgttatgataattatgggagtaaatatgcttggaatttttcaggggcttagaggttgcttgaaaaattatcccagtaagccacaaaaaatacaagatgcatttttctgtaaaaaacggattctatttctgcataaaatgcgagttccagttttccataaaaaactgattccatttgttcataaaaaaatatcaggcggaagaaaaacaccatttctcataggaatatgtaacggctttatgccctgcggaccacttcagtccatgcagatcgtagcgctcgcatctggaaatatatttacaggagcattttctatgttctgttttagccttggtacagtgccgctgatgttgggatttggctctgtagtttctgctcttggaaagcattttacaagacaggtattaagagtcggagcgattcttgtagtagtaatgggtttatctatgatgatgcagggaacttcattgtcgggacttgatataaaagttgcaagtgttttttcaacaaaagaaagcaagcagatgcaggcagataatacaaatatagcagtggagaaaaatggagtgcagtatgtttcaagcaccttggaatccggtcactatccagatatcacagtaaaagccggtgaaccagtggagtggacaatcaaggcttcagaaaaaaatatcaatggatgtaattacaaaatacttttacaggattttaatcaggagcatacctttaaatctggtaggaacgtaatcaaattcacacccgaaaaagaaggaacatatacctatagctgctggatgggaatgattacaggaaaaatatatgtgaaaagctgaaaggatttacctatgaaaaaatatattatgactataatgatgatgataatattatcactgacaactctctcaggttgtggaaaagaaaaagctagcacaagtgcatcaggtgtaaatgctacacaaaaaatagcatcaggagaaaatttgacaataccagtaaaagaaatatcagaaaaggcttcgttttactcagtagaagtagacggaacccagatggaagtcatcgcggtaaaagattccgatggaaatatccgtactgcattcaacacctgccaaatctgctatgattccggtaatggatattataaacaggaagatgatgaacttgtatgtcagaactgcggcaattcctttacaatgaatcagatcggtgaaagcgcaggtggatgtaatccgtggccgattctggaagaagataaaacagaaacagatagtgagataaaaatatcttacgaatttttaaaagaatcctcagatatttttgaaaactggaaagtgaattagcttctgatttgcgaagcaaaactcatgtgattagtatttcgaacgatttttcaaaaataaattcatatttgatttgttcaactcgacaaatcaaatatgaatttggttccgaatttccagaagttagatggttatctgaaacagcataaccataagtggcattgtaataatagcaagaagagtagttacaacattaattgcactggcgtactgtgaatcatttccataaacctggcacatctgtgttacgatagaagcagatggtgtgataatcgcaagaaaaacgataagcataattttaggtccgttggaagaaagtgaagcaaggtagctaaattttataagtacaagtgcgatagccgggacaacaatcagacgtaaaaatgtaacaaaatagactcgcttacttgcaaaaatctgtttgaaatccattccggcaaaaagcataccagtaacaatcatgcttgcagggccgatcatgcctccaacagcacttaatgtagagttaatatcttcaggtaaatgtattctagtcaggaaaagaacaatgccaattgcgatggaaatcatattaatatttaatacaatctttctccagtcataagtggattcccggctgataattttcttgcaatgtgtccatataaagacaagctgtacactcataaaaacacagccataaagaacccattcttttcctaaaataaacatcacgattggtacaattaagttgccggaattagaataatagattgaagcaacttccacttcattcaaatgaaatacttttcccaaaatagaaacaataatcaaaagaattacctgtgtcataacagaaccagcaagggcaataagaagtccttttactgtctgcggtgtgtaatctacctgaaaagcattaatgattacacagggaataataagataaagtacaattattgatagaatcttactgtcttctgagtttaaaagttttgcttttacaattaaaaatcccatgaaaatcataagaaaaagctgtatgatctgttccatgagaagaatgctgatatgcatgaaatcatctcctaatctttatatatcatagccaaaagtattatataacactttggggattctgtccttaataaattactatttaagaagtaggttaagaatgctataattttatttaaagaccatgaggaggaaacagtaatgaatttcacaacactttgttatatagaaaaagaaaatcaatatctaatgcttcatcgagtatcaaaaaagaaagatgggaataaagacaaatggattggggtaggaggacattttgaagaaggcgaaagtccagaagattgtcttttaagggaagtaagagaagaaacaggattagaactggttaattatcaattccgtggaattgtgacgtttatctctgataaatgggaagatgaatacatgtgtctctacactgcagataaatatatcggagaaatcggagtatgcgatgagggagaacttgtctgggtagaaaaggacaaaattaaagatttaaatatatgggaaggtgataaaatttttttaagactcctcgcagaaaatgaactatttttttcactcaaattagaatatcagggagaaaatcttataaatgcgatattaaatggaaaagaatataattaagaggctgtaaagacaggaaatagtttttaacctactcatcccaaacgtgacctcggagcaagtgctggatgcgagcgcttaagcgaacatccaacacgccgcgactaaagtcacatttgggatgagtagatggttctatttttgtctatttagacaagcaaattagattttataaaaatcccttctgctctaatgtgaagacaatgttacgtccttcgaatgtaccgtcaatgatacgtcttgctcttacactgtcaccgatattttcaacacgaacgttagtgtctttataagctttggatacttcttcgtaaactttgctctgcgctttcataccaagacatacgaatccatgatcgaatggaagctcgtaaacttcgccttcaggactcttaacaacgaagcagtcttcttttacttcctggagagctgtgcttgtaagctggtttacattgtatttttccatcatgcactttgtatcgttctttgttacagggtcaaggtcacgtccgattgctggcatcatttcaacgatggatacttcagcacctcttggagcgaagaattctactacgtcaagacctacagcaccaccaccgattacaacaactttctgacctgtcatatcttctgggtagtctggtacatgtttgatcatgcttaagatagattcaacttttccgccttctttatcaatgttctcatgaagtcctgagataggtgggagaagaggagcagaaccagtagcacagatgatgatgtgtgggttgaatttttcgattacttcaagagtagcttctacgttcttgaaaatgtaaaggttatcaagagctgcagcgcgtctctgaagatatacaggaaaatcatttaaacggtgttttgcaggaatcttggagatttctgtagcaagtccgccgagaacatcttttttctcaagaaggaatgtagtacatccaacttctgctgcagaacaagctgcttcaagaccagcagtaccaccaccgattacaaccacgttacagttcttgtttactttacgtccaagatgtgtgtctccttcaagaacagatgggttaactgtacaacggataggtctgtttccaccgatacggttaccagcacatccgatgttacaggaaatacattttctaagcatacattcctggtcgtttgctactttatgaacccagttaggttcagcgataagtccacgtcccataccgattaagtcacagtcacctcttgcaagagtatcttctacaacctgagggtcacgatagttacccatggagataactggcttgccgaatttctcttttacagccttagccatgtaagatctccagccatctttcatgtagttcgcatcaatctggtactggatagaatcgttaaggccacaagatacgtcaaagatatctacttcatcatttaaatattcaagatattttaaggtatcttctaatgtatttccacctttaacgaactcatcagcggaaagtcttaacatgattggcatatgaggtccaatctggcttcttacttcatcaatgatcatacggcagaaacgagttctgttttcgatgcttccaccaaattcatctgttctgtcattgtatacaggggagaggaactggctgattaagtaagaatgtccagcgtggatttcaacagcgtcgaatccagcagtctgtgcacgcttagcagcttctccgtatttctttacgatagcgagaatctcgtcttttgttaatggacgaggagtagctccgcctgtcttagatggaatattagatgcggatactggctgaagtccaccgatacgggaagacattgcagaagcacctgcatggttaatctggatagaaacttttgttccataacgatgcatatcttcgcagaacttgtaaagacgtggaagatagttatcatgatcgatacgaagctgtgtagtaccgttagaaccctgtgggaaatcaacgtttgcattttcaacgattaggagacctgtgccgccctttgcacgctgtctatagtaatcgatgtgaagaaaactcatttcaccattctgctcgccatagtttgttcccattggcatcatacagattctgtttttgattgtcattgtgcgaactgttaatggctcaaaaatatgtgtatacttgtctttcattatgaaaccctcctaaaaattattgtcattcgtagtacaaaaaattgagttaaaaatactagttaaacatactattttaacggtgttcaataactctattatacgtactattgaggaggattatcaatcgaaaacactatgtagattgatagaagttatctattaaattcattagagaacagacgcccgagaagagaatcgatgccctatatttgtgactttagtcgcggcggtttaaatgctcgctttatgcgttcgcatctaaatcttgctccgagtccacaaatatagggtatcgattctcttctcgggctgtctttggctggattttgtttgaattaaatagggcttgcggggatttgtgggagagagtagaaattttctgcttgctctgaaattattgtgaacagatgctttgcatttaaattgaagttataaaggttgaaaaggaaaattgaagcttgcttcttgctccaatataatatagtcaagtcaaatcatccctctattcccagtcattctcgagtaagcagaagacatcagcttctgtccccaaatcccctccccctgtttaattcactttctccagccacagcacagaagccagtgaacttcataagccatatttgtggtctcggagcaagtgttggatgcgagcgtgtggagcgaacattcaacacgccgcgactaaaagcacaaatatggcttatgaagttcactggcttcgtctgtagttcgcttaatgaattaaatcgtaacaaaaaaggagtaaagttctaaaaaatgtggtatcataagggacaaccatttttaacagagataaagtagaatgaaataaaaacaggaggaaaaattatggcaataataaatcttacgaaagaaacttttaaacagcagatttcagaagtagataagccagttattgtagatttctgggctccatggtgtacgtattgtcgaagaatcgcaccggcttttgataagattgcaagtcagcaggaggacaagcttatttttgctaaattagatattgatgatgcagcggaaattgcggaagagtatggtgttgatacaattccaactcttattatatttaagaatggtgaggttttcggaagtattgttgcaccggattctaaggcgaagattgaggcatttatcgaggaaaatttataatttatgataggaaggaagaaatacaatggaaaagatatatgatgtagtaattatcggaggaggtccgggtggatatacatcagctctgtattgtgcgagagccggacttagcacaatggttcttgaaaagctgtctgccggagggcagatggcactcacttctcagattgataattatccaggatttgaggaaggaattgatggatttagccttgcagaaaagatggagcagggcgcagaacgctttggcgcggagacagagcttgcagaagtgctgagtgttgatttctctaatgatattaaaatagtagaaagcagtgaaggaacatttaaggcaaagacagtaattatcgctaccggtgctgtaccgagagaacttggagttccgggagaaaaggaactggttggccgtggtgtcggatattgtgcaacttgtgacggtatgttttacagaaataagactgttatggttgtcggcggcggcaatactgcggcagcggatgcgatgactttatcaagaatctgtgaaaaggttatccttgttcacagaagagattcccttcgtgccacaaagatataccacaagcagttagaagaaactgagaatattgaattttactggaatacaacagtcagtgaatttttatatgagaaaaaacttactggagcgaaactgcataatgtaaagacaggagaagatacagagatttctgtagacggtgcatttatcagtatcggaagaaagccagcatctgagctgttcgaagggattcttgatatggatgaggcgggctatattgtagcagacgaatctacaagaacaaatataccgggtgtatttgccatcggagatgtccgtacaaaggcacttcgtcaggttgtgactgctgtagcggatggtgcgacagcctcacattatattgaggaatatttggctcaccagatataagaaaaagatatagaaacgaaaataaatgtaaatgtcagaatcaggtataatataataaggatgtctgagcattcttgaattctaaaatagtaaatgttataaagaagggagagctgatatttttaatggaaaaagaaacaaaaaaaagtcttttacttatcacatttggagtagtactatttgccctgctcatgcatttttcagaagtaattaagatactgcaaagaggagtgtcactgactctgcctattatggtaggtctgattcttgctttcgtcttaaatgtaccaatgaaaatgtttgagaggctttttgcaaaattaaaaaagaaatatccacaattaaagaaaataccagtaacaagcctcagtttatttgcaacattagcgtgcatcgtccttttaatcggaatcgtgtatacgatgttcgtgccaggacttgttgcctcggtaagaagcatttacaatgtttttatggaaaatatgccaaagtggttatcctggctgcgaagtaatggaatggatactgcatggatttccagagaggttacttcctgggatttcaataagctgctgactcagataaccggcaatgtaggcaatgtgggaaatgctcttggaaaagtagtagatgcgacaacgtccgcctttggtgtggcaatgaatgtaatgatgggatttattatcgctatctatgtattattaagcaaagtatctctaacaagacaatgtaaaaaaatgatttatgcccacttatcaaaaaatcatgctgataagatttgttacatatcaagccttgtcaatgaaacatattccaagtttttttctggtcagtgcatagaggcagttatcctcggattattaatattcattgcatttaccgtattccgcctgccatacgcaaacctgattgccgtactgacagcaatcctttcctttattccatacattggagcatttgcttcctgctttattggagcattgctcattgtaatggtagatccgtggaaggggctgttgagcattgtcgtatatcaggtcgttcagtttattgaaaaccagttcatctacccaagagtagttggcggttctgtaggactcgcaccactttggacattaagtgcagcgttgattggcggtaatctttttggagctattgggatgatatttgcgataccggtcacggcggtgttgtatgtgctgctcaaagatgatgcaaatcggagactgcagagaaagaagatagatatataaatagaaatttgccgcaggcaaaaagacgccccgaagagagtctaacccctatatttgtgattttagtcgcggcggtttgaatgctcgctttaagcgctcgcatccaaaccttgctccgaggccacaaatataggggttagactctcttcgggggctgtgctttggttgtggaaggaaaattgctatttattgttggagtgatttgggaaatcgccagaaggttttggctttctgtggagttgttttttgaaggattgacccgaattattgttgtagtatgctgaaaacatattaaaacagaaagcatttttcaaacacgctctagttcttgacatttatatttaaaacctttatatttaagtaaatgcttaattaagtaaatgctttattttggaggagaaaatgacagatatcgaattactgcatactattactatgccaacacggtaccagattcttatgcttttactggaacatcattactgtgggaaagcattggctgcgaagattggaatcagtgaagcagcaatatcacagcatctacagatattaaaagattgtggaatagtgacgggacaaaggattgaccgtcaaatgcattatcaggttaatacagaacttctgatacagagtgttggtatttttcatcagaaagtattggagaagagtgaacatatgccaaatagagattactgtgattgtgagcttgctgagttttgtagtcggaagggagatgtaaagaagtaatgagagagaataaagactatctgattacagaaaaaccatcgagagctttacttattttttcgattccgatgattattggaaatctgtttcaacaggcatatacaattgtagattctgctatagtgggacgttatgtaggagaaacagctttagctgctgttggcgcatcttatgctctgacaagtatatttatttgtattgccattggaggtggtattggtgcatctgttattatcagccatcactttggtggacataattatggacgtatgaagactggtattcgtactgcgttactttcatttcttttcattagtttgatacttggaggcattggattgattttcagccagcaaattatggaggttttaaatacaccggcagatgcaatagatattgctgtaacttatttgaatatttattttttgggactgccattcttatttatgtacaacattctttcttcgatgtttaatgcacttggagaatcacgcattccgttgtatttactgattttttcttctgtattgaatatttttctggatttatatatggtggcagtattgaatttaggtgtggctggtgcagcatatgcaacgtttattgctcagggaatttcagcagttttatctttgattatttttattgttacgcttcaaaagttaccgggaaaagctgagggctggctgagcaaaacagaattttctgatatgtccaggattgcgttgccatctatccttcaacagtctacggtttctattggcatgatgctagttcagtcagtggtaaatagctttgggacacaaattcttgctggattctctgctgcgatgcgaatagaatctctttgtgttgtaccaatgtcagcaataggtaatgcaatgtcttcttacactgcacaaaatattggtgcagaaaaagaggagcgaatctcacaaggttaccggatgggcaatttcatgattattgttatagcggttattttgtgtttattcctcgaaatagcccataagcctctgattgccttgtttttagataatgcagcatcatcacagacgattgttactggagaaagttatctgaaatttattggtttcttcttttgtatgattggatttaaaatggctgtcgatggtattttgcggggagcaggagcagtgagagtttttactattgcgaacctggtaaatctaacattgcgagttaccattgcaaaattcggagctccaatttggggagtttctatggtatggtatgcagtaccgcttggctggcttgccaactttctgatttcctatggatattacagaactggaaagtggaaagaagctgtttcaaaaacggtagattagatgaggaaagctcgaaatcccatcccctatatttgtgactaaagtcacaaatataggggatgggatttctttgtggatgtccgtcccgctgcgtaagtcaggatttttattctcttacagcaagaagactccgacctctaaggtgggagatgaattgcgtctgttacctacttgatagagcatcctaattatagtatagtatctttagtcgaataataaaaaattgagataataatgtacatttagtattcttactatactagcattgtgtgcttgtagtcaagtatcgcaggcggtttttcgcggaaaaggaagtggcatggtggcaaacagagcatataaattcagaatctatcccaatgatgaacagaagattttgtttgctaagacttttggctgtgtgagaatggtatacaatcattggcttgatagaaaaatccggcagtatgaggagaacaagacaaacgtaacatataccatttgtgcaaaagaaatggctgcaatgaagaaaacagaagaatacggatttttaaaggaagtagatagcatcgcattacaacaagcgctcaggcatcttgatacggcatttcagaactttttcaaacagccgaaaacagggtttccacggttcaaatcaaaaaagcggaataaaaacagctattccacggtctgcatcaatgggaacataactctgtctaatggatatttgagattacctaagattggacaaatatggttaaaacagcacaggattattccagatgaatacagactgaaatctgtaacagtaagtcagacaccaagcggaaaatactatgcaagtattctttttgagtatgaagatcaagtacaggaaaaggagctgcaaaagtttttaggtttagatttttccatgcatgaattatatcgtgacagcaatggtaaagaacctgcctatccggggtattacaggaatgtagagaaaaaattagcgagagaacaacgtaagctttccagaatgcagaaaggttcaaacaatcgcaataagcagaggcttaaggtggcaaaacttcacgaaaaggtttccaatcaacgaaaagactttctgcataagcagtcaaggcagataaccaatgcctatgattgcgtatgtatagaagatctggatatgaaagcaatgtcgcggtcactaaattttgggaaatctgtttcggataacggctggggaatgttcacaacatttttgagatacaaactggaggagcagggtaagaaacttgtgaaggtggatagattttttgcaagcagccagacctgttctgtttgtggttacaaaaatgcaaaaacgaaaaatcttgcgttaagagagtgggattgtccacagtgtgggacccatcatgacagagatgtaaatgcggcggtaaatatcagaaatgagggaatgcggctgataattgcatcatgaccttaaaaaacataacacaaccgtgggacacacggggatagctcgcatatgcttagcacggtagtgctatcgaacgagaaccaaacttgccgaggatgggaagccccaacctctacaggtgggggaggatgtcactcttcatctctggtgataaacatcattataaatgccaacaacagcaatacggaagatataaggattgcccgttcatggaagtatttaatacactggtttccgatgatcgccccgcagataaagcaaagaataattccgtaatagagaagccctttttcaagagcttctcttttttttgtctggaagaacgtgtaaatattctgtgtgccgcttcgcaagtttccgatgcacatagtagtagcgataccatttccatgaattttacgaaaactttctacctgaatgccacaggcgagggaagttaagctatttgcaagaaggttatgactttgtgggagaaagcttacgatagtaagaataatagcctctgccacaacagaaatctgccgccaatgcaaatgacttcctattcctgaatttcggacaatgtctgcaagtgcgattccaaaggtaaaagcaagaacagggcaaaggtagcggatagctgcaggaatatttccttcagaaagatggacaccgagaaggagcatatttcccgtctgggcatttgcaaatacctcgcctctgccgatataggaataggcatccataaagccgccggatagcgcaagcaggataccaagttctatggattctgaaatttggacttttttattcaaacaaaaaaccttctttctatctataagtgtgatttacaagttctatacacaatatcttcaaaaaaattgtggatagacgcagtgctttgggaaaatattgtggataactttataaaatttgcatgatttacaaaaaataattcaaaagatgccgtaatgattatagtgggaatgagactgtttgtcaattagaatatctttactttcaaatggtagaatgttatcatagtagctgttgaccaaggaaacatctacatgattttttcattaaaaatataggaggattgcaatggcaaagaaagcattaatcgctatgagtggtggtgttgattcatcagtagcagcataccttatgaaagaggcaggatatgattgtattggtgtgacaatgaagctttatgataatgaagatattggaatggcaagggagaaaacctgttgttctttaagtgatattgaggatgccagaagcgtgtgtgttaaactgggaatcccatattatgtatttaattttaaagatgattttaaggaaaaagttattgataattttatttcctgttatcagaatggaatgacaccgaatccctgcatcgagtgtaatcgtcatttaaaatttgagcatttatataagagagcgaaggtattacattgtgatgttatcgtaacgggtcattatgcaaaaatcacacacgatgagcagggatatcatctgttaaaaggtgtcgatgacagcaaggatcagagctatgtactgtattctcttacacaggaacagcttgccaatacatgtttccctttgggagattacagcaagacagaaattcgtaagattgcagaagaacagggatttttcaatgcccataagcacgatagtcaggacatctgctttattccagatggagattatatgtcatttatcgagaaaacaacgggcaaaaagagcgagccgggagacttcgtaaatcaggaaggcgaagtagtcggtaggcacaagggctactatggctatactatcggacagagaaaaggtctcggcatatccgcaccaaagccatactatgtaacagaaatccgcccggaagagaataaagtcatcgtcggaagcaatgaagacttatttaagactgatttaattgcaaatgacttcaactggatagagaacttagcggaggacgaagtcgctaaggcaagaatccgctatcaccagacagaaaaagaagcaaccgccaggaaaaattcagatggaacagtagacattcatttcttagaaccacagcgtgcgattaccaaaggccaggcagtagtcctgtatagggataaccacgtagtggggggaggaacaatcataaaataatttttgatttgccgcaggcaaaggagacgcatcccaagagaaaagaaatctgtggtcggattgccagaagaatttagaaaagagtcagtaaaaaattaccccattttgttccgttgtgctaaacgttccattttgcccaataaaacagaaacttcggagaaacgaatccgaagtttctatggtcaaaattccacagcacaaagtcacaaaatggggtgattttttactgactcttcttctcgtattcttctggcaatccgaccacagatttcttcactctcggggagctgtgctttggttggggcagaatcagaatattatgttagataattttgagatttttcaaaaggttatggctttccagaaaatgaatactaaagattgacatataagtgattgctatgatatcacagcaattttacaataataaattaagttgtcttttatctattttgcagaattaaagtaagcaggcgttttcaaaatttttaagccggattgcacagaaaaaattgaaaaagaatgggttcactataagattgaattttattcctttgcgctgtggagttctgactgtaacctcacgagattgtttttgagcaaggttgttttatcaggcagaatggaacatttagcgcgacagaacaaaatcaaacttataatgaaccccttctttttagatatctaagataatctggcaacagccaaagacagctcccaacgagagaagccatcctatatttgtggccttagagcaaggattgaatgcgagtatgtaagcgaacattcaacccgtagtgatagagtcacaaatataggatggcttctctcgttgggagcgtctcccctgcctgcggcaacccagagcttaataagaaattaccgtagtattcgctggcatatatttccagatataatatgcatcggagtccatcagacgcacacatccattagatgctggtttaccaattgtagcatctgcatacaccgtgcttgcaattggaaatttatgatgattctggctgctgccggatgggtaacggtgtactctggtgtggaaagagtttcttccacaataatgagttatgtattcttcataagtattaacataataccagccattttccttctgaccaatgcggaaagttccatggggagaacgggtattatagtttccggaggcgcaagggaacgatttaattaatttccaattgttctttcgaccctgaaaaatgctgacttcctgtgtataatgactgacccagattaaatagctggttttgctggaatactttttaacataagcaagtttttgagcagtagaatatttggatgttgtgtagttgcatttgaaagcgcgaagacttcctgtagtgaggtagtaggtctttcctttatagagaatctcgcttctcttatatttggtattacgtccgattaaatcaacggttacaccgctgcttaatgttttaacaacttttttagaagtccaggaacggtaaagagaaactttcttggttgtcttgcagaagtaagtcatcgttcttattgtttttaatggtgaaagtaaagtgttaggggtacagcttacagtagctcctgttgaagaagtataattctttccattaatcgttgtgtaaggttttaccataaaagtaatacttgaagcgccgcttgtaatggaagtctgataagtggagcgggtggtgtttgctaaaagagtgtagcggctgcccttttttttatatacactgtaaccgcttgcgttataaagtgtgttccattttaagttgagacggctattgcttgcgtagacagataatccagttacattctgtgaaatggttacgggaatcgtagcagagagctttctggaaactgtttttgcgttaggagcgaatgcttttacagtaaatgtgtaggtctggccttcatttaactgattaaatgtataagttccggcttttttaaacttaacagaacgtccatcggaacaaaagagtttatatttattagctccagtgacggctttccatgtgatttgtgcacttttatatcctggtgtaacagtaaaataaggtgctttcagtgagacggcttcggttgaactggttgtgctctggcttttgaccgttgtctgacttgcattcagagaaactgccggataagtgcaaagcccgaagaataaaagggctgaagcgacagaaagacagagtttatttgttattttcatgaaaaatctcctctctcatagtattaatggtcattgataatttactatctgactaatataacaaatcctgctaccagaagtcaaggagatggatttactatttaattcaaacaaaattcagccaaagccctctgtttccatcccccgaatctctccaaccattattttaattcaactaaaaacagccaaagacagccccggaagagaaacgctatcctatatttgtggccttagagcaaggattgaatgggagccagtaagcgaacattcaacccgcagtgatagagtcacaaatataggatagcgtttctcttccggggcgtctgtcgcttaacgaattaaactagccaaaaattctgggagaatactttctggtacttccatttctccctgtcctttaaataaggaaatatgtggtttgttctgaccgtggaagtctgttccgcctgttttaagaagaccccactgtttggcaagaccagcaacatattcctgttcaacaggagtgtaagtgttatagtaagcttcaattccaacaaggccggcttcttttaattcgcggaccagagtttcttttttggcggaatctaactttttatagaacataaggtgtgcaagaacagggacaccgccactgtttttgattagttcgattgcttcctgcggagtaggcatgatacgttccacatagcagcatcttccctctgcaagatatttatcaaatgcttcttgaacagaagaaacatatttctttttcataagaagctttgcgatatgtgggcgggcgattgtttcgcctggcttatctggtttgatttcgtccatggaaatcttaaagccctgttcctgaagtttctcaataatttttgcattacgtccgtcacggctttcacgacaaacggcaaggcgttctaagagagccttattttttgtgtcgatgttatagccaagaacatgaatttctactccgtgatagtctgtagaaatctctacaccagagatggcagtaagtcgttctttatgtttggcagcagctttctgaaattcttctgtgccagcaactgtatcgtgatcggtaagagcaattacaacaggatttttatcaccagcaagttttagggcatcatttataatttctgttggggaaaatgtaccatcagaagcagtagaatgaatatgtaaatcaatataagttttcaaaatgtactcctttcatgcaataatcaatcaagtatctataatattctatatctagtatcgcagaattagttaaaaaaatcaatgtctatgacaattatttatatgaattgaaagaaagtgatggaaaatgtgtaataatgcaatacttgtttgtaataattgcataaaggtgttagaatatctttattgagaatgagaagctaaacaggcagacagaacatgtaacggaggttaatctataatggaagatatgatgaaagcgttgttggatgtggtgagagcacagcacactgcaacagaaggaagcgaagaaagaccatttgatattaatgatattattgatatggcgctgaatattaccgggagaccagaagaaccagaggaacagcaggaactttctgatacgattcagaagctggcagaatctctggcaccagatattttcccaccgaagacatttgaggagatggatgattccgagcaggcagcttctgcagtgaatatgatagaggaacggttaagaaatggtggcagaagaagagagacagcagccccacagtcacaacaggaaatgactccgcagcagaatagtttacagatgcagagtgagtcacatgaggagaatccttttgcacaggtaatggagaatgaaaatgcgaatattcagcaacagtcagaaactgcagatggatatggaaatatggcatccacagacagtggtgcgtccgaagattatggtaatggcagttcttacgatatgtttggacaagacgatgtaaatcatcaggaagcggcgaatcttaatgatttgatctataataattttatgcagatgatgggattaaatgatcctaaggtagaatatccatttgaccgttctcagattcgatatggaagggaaaagacagcgacggaaatgcttgcagaagatgaggccaacaaggcagaagagagagcattagaagagcagagaagaaggccagtttcagcctgggaacttgcacagtcagctgtggataaggatgaggaagcacatcagaaagaggaatatgaacctaaagagatgaagatgccagaaaccaaatcagcttctcagttagccgcagaagcaatcgcgaaggccaaagaagaggatcagatgaagcttgaggcagaaaagagagcagaacgtcttatggaagaggcaagaaagcgcggaaaagatccgatggaatttgcacttcatcagcaggaaattttaaattatatggaaaagaacagtgatgaactcgtttcttttgaagattatgaagatttatcaccagaggaaaaattagagatagagaaagaactttatcgggaaaaacagattgaagcgggagtggctccagaagatatcagtgatgagttaccagatgagattctggaacagtctggaatcgcaccagatcagacagcaggagagcagaatagtcaggagtctgccggacagggagatggaacaacagcacagcaaaccagccaatcacagggaatgccggcattttcagatgatatgcttcgtatgattagtcaggaagtagtacaggaaaatgcagagatgattctggctgaagatgccaatgcagacttaggattaattaacgagacgattttcgaaaacttgaaaaatctaatgagtcagactggcggagctgtgacgcaggaagatatggaatctttgatcggagaagttatttccagaaatacgtcttctgactcagaagaaaaacaagaaactttggcgcagacggaaacaggtactacagctgaaacggcaccgatggcatttgaaggcgaaagtgcaggcagtgctgttggaagtggaatggcaggaacgagggaaccagcagtggaaagttcacagtcagaatcacagagccagccaatgtcagcggtagaacttgccagggcagcacagcaggcagctaagccagagccacaggaagccagagaaacaaagtcagcagtagaacttgcaaaagaggcacaagaaaacgcagtacagaagaaggctgaaccaatatcggagacagaggaagaactgagcgaggatgatttaaactttgatgaattagatttagaagaggagtccgaagaaagtcaaagtccttccattgaagaattaaaggcacagcttaaggcagcggaagaagcattggcagcagagcagttaaaagcggcacagaaagccgggaaagcagaggaagagaagaaatcagaagaaattccgaaagaggaagaagcaacagaacagccgatggaagagagtgcatcaacagccggggaacagacagcaacagaagaaagttctgagataacccctgcgccgacagcagaagaagtacaagaacagcctgagtattctgaagtttcagaaaaagaagcggaagaatttgaatatgttgatccgggcgaattagttcttggagaccacacacaggcagagatagatgaagctttggataatctggcatctcttggcctggagggtgaagtctatgagcgtgcaaaaagaatgctcttactggaacttgctggttcagaagtagcacttgatgcatggcttgaagaacaggaaaatggcaagaagaaaaaggcagcggtatccgcgttagatacagaagaagatgctcttgaagatttagaagatttagatgaagatgacctcgagcgagaattagaacttgctatggatgaagactttattgaggaagatttagaagaacctgcaaatgaagaaactttagaagaaagcagtcaggacaaatctgaagaaacagaaaaagaggcagtttctgaggagaatttagaagaaaactctgcagaaaaaacggaggacgaatctgataagacggaaggtgccgaagatgtatcagaacagccagaaagtattttaaaagaagcttctgaggaagaaataagcagtgaagaggaaaactctgaggaagaagagggagagacctcagaggcagctcaggaagaagcagcaaataaggagttctctgagacagaagaagaggcagcaaatagagaatactctgagacagaagagaaagaggcagcaaatagtgagtgctctgagacagaggaaaaagagatagcaaataagggagtttctaagaaaatagagaaagaagcagaatacaaggaagcagaatacatttctgaatcagaagacacaattcaggtagaaaaaacaagaccggaaaaggcagagaggacatcttcacagacgaagaagcctgcacacagtgagagaacatcacattccagaaaacacaagaatattgtaaaacgtaaggaaaaaacagctccagaaaaagaagaaagagaatttagcgcagtagttctaacaggaaagaatgtcgaagaaaaagaattccaggtaagtgtccgcaatccatttgttctcaaaaactctgcaagctttatggataaatttgaagagtatattgtagatacacaggaaaacagaaagttaagcacaggattcaaacgtttagatgcaatgctccgctatggccttcataaaggaagttactttgtagatgctacacctcagtatttaaagaacggatttatgcagcagatagccgaccgggcagcagaaagcggtgtagatgtactttatatttcaacagagcttacccgctatgaccttatggtagatactatctctcgtctcagctatgaaatgaataaaaaagatgaagaaaaagcagtatcctctatggcaatcatgacaggagaaaaaggcgcagatattcgttctttaaaagatgaattgaattggtacagaggacgaatcagtgaacatctttttgtacttgatcaggaagcagtgtctgaatatgtagaaaatatggaagatgcctccgcaggagatatattagcagaacttattcgttccatcgtaacagagggagcacataagccagtggtatttattgataatattgaaaatatactctcagtagaagattctgaggatatgaaaccgctcatggatggaatccgtaaacttgcaaaagaactgggaattccgattattatgtcctacggatatgcaccagcagaaagtgaaaatgagcttgacccagatgaaatcgaatatcacaaatcattaggaaatatgtgtgatgtatatcttgaactcaaatatgcagatatgataacagaggattatgaagaattaacagaagatgatattcaggaaatggtagaaaacggtgaaatgcttcttattaacgtacaacttcataaaaatagaagaacaatgaaagcatcctgtcagatacaggcaacaccgaagtttaattattacgaagaatagtgatttgccgtaagcaaatagacgaaacaccaaagagaagatatcctatatctgtgactttagtcgcggcggtttgaatgctcgcttatgcgcttgcatccaaaccttgctccgaggccacagatatagggtattatatggcgctattccgtaatcccaatataatccgttacaaccttaatcttcgcactgatcttctgaagctcttctgttggtttataatctttcgtaccaaagagatattcgtgtgctttttttacatttgtctgggctgtaattggaaaaccgtaatagatgccgttatatcgttcatcttcagatttaaaaggataagcctgcgaatcttctatcttacaacgtgccatggaaagagtcagctttgtgagagcgtcattagagaggctcgttttacactgtggaagaacagtactgattaactttccaagttttagcggctgttttttagctgtattcataataccttcaagaacaagtcgctgatggttagctcttgcgtgatctccgccttccatgtagcggatacgagagtaggcaacagcctgattaccatcgaaggtataagttccggttttttcaaacttcggagaatttccaccattaatatgattcatattaccaatataatcatttaaattctgtaattctttttcggaattaatggtcaatggaatgccgccaagcacatcaacagcatcggctagtgctttaaagttaactgtggcgaaatctgtgatatttaaatccaggttacggttaattgtgcgaagggcaagttctggtccgccataagaatatgctgcattaatcttatcgtattcgccatcaatacttacataggtatcacggtaaatagacatcaattttacctttttggttgatttattgatgctggcaatgatgatacagtcggtacgggaacctttatctttaattttattatcctgactatcaacgccaaaaagagcaatattttgataatcttttatattagcatccgtatcatttacagttacacttgttttatctaaaggatatttttctattttggagaatgcaccttttaatgagaaacggaatgcaaaaaccgccccggcaattaaaagaatgattaaaagaaggaagggaaaacatccccgttttttcttttttttacgttcatgataagttaaagctcgtccgccagaagtctgccgcttttgagactttgtatcaggcttgttctgggaagaggacttctttgttgatggtttgccagaattttttatagaagaaccagaggaatgatatcctgtaccggaagaacttcgaagcaggccatcagtattcaatgtggaatgtgtatgatggtcgtgagaagtttcgaaattattctgagaacttcgtctgccgcctgtgctggaatagttatatttgttttcaatgttatctttactatatattgaaccatatttcataaaatatgcctccattctgtcataggtacttctggaaatttaataggtttatggaatgtttcggagagtacattcattagttaaaaaatctgtgttagtaagcatttttattgacaaatcctttaaatacagtaagaaatagaatcttaatatcaaaagataatgtccagttttcaatataaaaaatgtcatgttcaattcgtccctcaatggatgtgtctccacggaagccgcaaacttgtgcccatcctgtcataccgggacgtacctgatgctttatcatataacgaggaatctcctctttaaatttctcaacgaaaagaggtcgttctggccgtggaccaatgagactcatatcaccctttaatacattaaataactgtggcagttcgtcaagactggtcttacggataattcttcccacgggagtgacccggggatcgttgtgtactgtccaggccttttgttccttagaggcagactgtactcccatcgatcggaacttgtacattttaaaaggtttattatgaagaccgactcgttcctgacagaaaataattggtcctggggaactctttttaacgagaacagcaacaacagccataatcggtgaaaagagaatgatacaaacgatagaaccaataatgtccacaagacgtttgatacatttgtttacagtatttgtaagcggaacattacggatgttgataaccggaagtccgttcaaatcctcagtaactgggttagtagaaataaatttataataatctggaacaaactttgtatgcacaccagacttttcgcagatagcaaccatatctcccagtttataatactctttcaagctgagtgcgattgccacctcatccatagaagtgttctgaagaaacttttctacatcctttaacttaccaatgcaaaaagtattgcggtaagaaaagtcagccttgagattatcatcgaaaataccgtgaatggtgtagccccactgtgggtttgacttaatacggtcgatgtaggcttcggctgctgcactgaaaccaataacaacaacatgtttaagattaaatccctttctgcgagttctttctaatgcataacggattgccgccctttcagcaatggtaagaagcatggaaagaacatagaacattaactgaagacttcgtgaaacatggggaatcttcataaagattatatatataaagaagaaaaccattccaatggaattcgccttaatgagattcgcatactctgaagtcctattttgaaatctttttggtttatataaattaaactttgcatataaaataaggtatacaggaatcagaacaagaagtataccctgatattgccacaactgccgccagtaaccaaaacgaggaaaaatgtctttaaaaagagggcatatatatcgaatatagtaactaagacaaaaggaacaataaataaccagtgcatcaagaacgacgtggaaccggttaagatatttttgattctctttaatcataaaagtgtacctccatcacccaaaagggatatatatatggaaaaaagggcgtaatatacctcttactgggataattttctaacttattatacaatagaatagggcattccacaaggttatttcttttcctgcttttacgaaaaaagtgtgaaaaagctgcaaaatcagtagaaatccataaatttgccataaatacaacacaaatttatcacacatcgttgctaagataaggttacaaacttaggaaaggggataacattatgaacgaatttgaaaatggattccataatgagaatttagagaacaacaggataaataaccaggaaaacaacagtcagcaagtagctatagatgtaacaccgattgaggaatcggtaacacaggagaatacagagagtcatagatattcttacagagaacaaggtacaggtggcagttcctatcagtatgacaatggaaataattgcaacgatacttataataattcttatagcagccacggatggagagatgagagtacttataataatgaaaattattatgggaatatcccgccggaacctgataagagacgcagacagagaaagaatggcagtaaaaataataagaacggaatgggtaagaaagccgccaagttagttgcatctgcagcagtatttggtcttgtagcgggagcctgctttgtaggagtgtccgtagcaaaagataaattatatccttctacagcagatcgaattgaaacaacatcgggaacaacaagtgcaaagagcgagacatcatcaagcggctcaagcagctccagcagtaatgtagcaagtgtagttaatgaagtgatgccatctgttgtatctattacaagtacaattcagtcttccaattattatggctttggtacacaggaatcagaaggagcaggttcaggatttatcgttgcaaagacaaaagataatcttatgatcgcaacaaataatcatgtagtatccgatgccacttccctcaccgtaggatttgtagatgatacaacagcaaaagctacagttgtaggaacagattccagtgcagaccttgcagttatttctgtaaagataaaggatatcaaagactctacagcatcaaagattaaagttgcaacacttggaagttctgatgatttaaaagtaggagaagaagtagtagcaatcggtaatgcattgggatatggacagtccgttacaacaggtgtagtcagtgcaaagaacagagaagtatctttaacagatggaacaatgaatcttcttcagacagatgccgcaatcaaccctggtaacagtggtggtgtacttattaatatggatggtcaggttgtaggtatcaacaatgcgaagttagaagatacatccgtagaaggtatgggatatgcgattcctatcactacagctaaaactatcttaacagatttaatgaatgccaacagcgtaagcacaaaagatgctgcattccttggagtcgtaggccgtgacattaatgaatcttattccagcgcacttggaatccctagcggaatctatgtatcacaggtagtcagcggatcaccagcagaaaaagcaggaatctctgcaggcgatgtcattaccaagtttgagggtaacaacgtatctacaatgtccggcttaaaagaaaaactggcactgaaaaaagctaatacaaaagtaaaaatcacatttaagagagcaaaccagagcggaacatacgaggaaaagaccgttacagtaactcttggtaaaaagagtgatttcagtgatgtaacaacagataactccagcgattccagcaatgattccaataataactccaataatggaaataataatggaaacagcaatggcaactctggtaatagcaatggaaattccggagactatggttatggcaatggaaattttggaaatgacaatggcaatggatatataaatccatatgaatatttcttcggaaataactattaatttaccatttaattcggaagctgtctttggatgatttttagatgaattgaatttaatcatagtccaaaacagcaatctacaaatccctcccttgatagcaggtgatagcataaccatggtcagtgcatttttgcaacggcctagagcgtgtttgaaaaatcattcctgcaacctgcacgccccaatttgcggtatattttgccttcattcagttgacgtagcccgctacgccgccctcattcaggcgaaatctcccctaaattgtaacgcacatcttgcagaaagcatttttcaaacacgctctaatacagaaaaactttatacaatattatataaaaatgtgccttagaacaagctcttaatgcgattgagcattaagagtgcagtgatacgaagcattttatataatattgtataaagtttttcgtctgttttttaaaaaaacacttgacatctcttcatacccatgatatcataccaaagtatgaacgccgaagacagcaggcgccgtaaggcataaagtgagaacacctgccgaggaagttatattcagataattttattcttagaatatttctgctctttgtctttggacagagagtttttttatttcatcgaaagatgaactgacggcggtacacacaaatatttaaggaggtgcaccaggaagatggctaaagtagaattaaaacagcctattgttgacgagattaaggctcagcttgacggagctaaatctatggtagttgtagattaccgtggaatttccgtagctgatgtaacagaacttcgtaaacagtgtcgtgaagcaggtgttgtttataaagtttataagaacactatggtaaaacgtgctgtagaaggtacagaattcgaaggcgttgtaaaagatttggaaggaacaaacgcatttgcaatttccaaagatgatgcaacagctccagcaagaatcgttgctaactttattaagaaagcaaaatgctgtgagttaaagagcggtgttgtagaaggtacttactacgatgcagcaggtattgcaacaatcgcaactatcccatcaagagacgaacttatcgcaaaattcatgggaagcattcagtccccaattacaaactttgcccgcgtaatcaaacagatcgcagagcagaaagatggtggagctgcagaatccgaagcagcagctgaataattaatattataatataagatttatggagggaaataagatgacaactcaggaaattattgaagttattaaaggtttatccgtattagaattaaatgatttagtaaaagcttgtgaagaagaatttggtgtatccgcagcagcaggtgttgtagttgcagcaggagcaggtgctggagaagcagcagaagaaaagactgaattcgatgttgagttaacagaagttggcggacagaaagttaaagttatcaaagttgttcgtgaaatcacaggtttaggattaaaagaagctaaggctgtagttgatggtgctcctaaggcaatcaaagaagcagtttctaaagaagaagctgaagacatcaagaaacagttagaagaagttggagcaaaagttacagttaaataattgtagttttccaatatttaatttcttgaacgaacgctcggagggtgtaagctctccgagctttttttgttggaggtataataatgagtaaaaagtgcccttatgaaaaaaaatgtggtggctgccagtatattgacctgccatatgaagaacagttaaagaagaaacagaaaaatacaaataagcttttaaaaagttttggaaaggtaaagccgattattggaatgaaagatccgtggcattaccgtaataaagtacatggagttgtagcaggagaccgccacggcaactgctttacagggatttatgagaaccgtagccatcgtgttattcgtgtcgattcctgtctgattgagaatcagaaagcggatgaaatcatgaatacagtaacttcccttatgaagtcttttaagatgcgtccatataatgaagatactggctatggatttttgcgccacattttagttcgtaccggttatcatactggtcagattatggttgtattagttacagcatctccagtatttccatccaaaaataattttgtaaaagcacttcgaaaagaacatccggaaatcacaacaattattgcaaatgtaaataacagaaatactagcatggttcttggggataagcagcagattctttatggaaaaggctatattgaggatgtgctttgcggcaagacattccgcatttctccgaagtcattttatcaggtaaatccaattcagaccgaagttctttataataaggcgattgaatttgcaggacttaccggaaaagaaagagttattgatgcgtacagtggaattggcacaattggaatggtcgcaagtgataacgcaggagaagtcatttctgtagaattaaatggagatgcggtccgcgatgctgtcttcaatgcaaagcagaacaaagtaaaaaatattcgtttttataaagatgatgcaggagattttatggtaaaaatggcatcacacaaggaaaaagctgatgttgtctttatggatcccccacgttccggaagcgataagaagttcttagattccctgcttcgcttaagaccaaagaaagtggtttacatttcctgcaatccggaaacacttgcccgagacttaaagcaccttacaggaaatggataccgtataaaagagattcagccagtagatatgtttccttccaccggccatgtagaagctgtttgtttactatcaagaagagagaaatagtacgaaaacaaagcgtatttctgttttttactaacactcacgagtacctttatagttgtccataagatgaggataggaggaatcatggaagtaaggaaacgatttgaaaatgataaattaaaaaaacttcagatttttaatggggcacagttaaaatatatagcatttatatccatgctgatagatcatgtaaacaatgcgttgataaccccttttctaaatgggaagggatttttattacatttatctaatcttttttcaattctgggcaggattgcatttcctatttttgtgttttttattgtagaaggattttttaagaccagtaacaggaagaagtatcttataacgcttttgctatttggtgtgatatctgaagttccgtttgacatgtttacatcaaaagtattctttgatccatattggaataacatcatgtttactttagcattatgtcttattacaatttggattattgatgctgtaaaagcaaagattagcaataaagttttgtggtatagtatctcaatcgttgttgtagggatttcgtgtgcagtagcgatggcgctcagtctggattatgattatcatgcgattattgttgcatacattttttatattttttatgataaaccaatacttggagcgggattgggctatctttcgattattaaagagttatattcttgcttgggatttgctatgacagtaacatataacggtgaaagaggaaggcaaaataaatggataaattatcttttttatccggttcatattttaatattaggtattctgcgtttttacttaaatatttaaaaatctttagaaatatttagtaggaaagaaaacaggggtatgttatagttataactagagcgtgtttgaaaaatcattcccgcaaattgtgatgcacatcttgcagaaagcatttttcaaacacgctctagtgttaagacttacacaaacaaaaagaggaatatttcacaagaataacaggcaggttttacatgcatttgatttggagttatagggatagttatagggaaagatacataagaaacacatatttatgaaagaaaaaagtataattcaacagaacttaaagaaaataattggtgttattgtggtttctgtttttgccataataacgatttatacggtgtttcaggggagcggcatctctttgaacgaactgacggcaagtttaaaagaggcatcctgggaaggtattttgctggcatcggtaagtatgcttggttttatttattttgaaggggaagcattaagagttcttgtccggcatatgggatatccggcaaagagaagccatggctttgtttattcggcggcagatgtgtatttttctgcaattacgccatctgcttcaggaggacagccggcaagtgcatattttatgctgaaggatggaatagcaggaacagcagttatggctgcgctgctactgaatcttattatgtatacccttgcgattttgacgatcgggctggtagatattttgatttttccggaagtttttctgaatttcagtatcgggtgtcgagtgctgatcgtggcaggtggtttagctttagcagggcttgggattatcttttatcttctgctgagaaggcaggcattgatcgaatctgtcggtaccttttttgtccggattttacggatgattcattgtgggaggcttgcagataagttagaaaagaaactggaagtttctatcgagaagtatagtagtcttgtggatgtgatttttgatggaaagagaatgttatggaaggtgtatatcctgaatctgttacagagattgtcgcagattatcgtaacacttttttcctttgcagcattgcatggagatttacgcaagcttccacagttattagcaacacagatttatgttgttatgggttcaaactgtgtcccgattccgggaggaatgggagtgacagattatctgatgttgaaaggatatcagcagcttatgagcagggaagccgcatttcagcttgaaatgcttagcagaggcctgtctttttatgtctgtatctttgtaagtctgactgcagttttgataggatatgtaacgattaagagaaaaaagaaattggagaatgaaaatgataggattttatgattacacagtgatacttacttatttgtcactgatgtcgggaacaataggaattatgctttgtctaaatgggatggggcatccataccttggtatgttttttctgcttttttccggactgtgtgatacatttgatggaaaagtagccagaagcaaaaaagaccgcacaacacagatgaaaaaatttggcattcagatagattcattgtcagatttgatagcttttggtatgctgccggcatgtataggaatcgcaatgcttcgctatacgatgtgtattcctgatttatctggagtgacccgctatttgctcacgcactatactttacagacacagattgttttaagcctgattgctgttttgtatgtacttgctgcaatgattcgcctggcctattttaacgtgatggaagaagaagaccagaacagagatgagacaggagccaaaatttatacaggcttaccagtaacgtctgcagcattaatttttccagcagtactgcttatacatatgcttattcgtgcagacctgacatttttgtattttggagttatgttgattacaggcggcctgtttatttcaaaaatacagattaaaaagccgcagaataagggaatcgctactatgattttctttggtgcggtagagtgcgttgttttgatttttgcgttgaaatttttgaaaaagtaaagttttcatataaacatttaaactttgtagtattttatgagaatactatggaaatttttgtacataaattttaagaattaagagattacagacaggagatttacatatgactatcctagaatttttatataatacagttccaggaagatttcttttaaaaccgttaaccggcccacggctttctcgtatctgtgggcattttttagattctgaattgtcgtcatttctcattcaaccatttgtaaagcaaaatgcaatccaattatcagattatgaaacaacagatataaaaagttttaatgattttttctcaaggaaaataaaacagggcaagcgtccgatagatatggaggaaaatcatttaatcgcaccatgtgacggtctattatctgtctggaaaataaaagagaataccgtttttcctgtaaagcagagccattatacaatttcctctctgttgcacagcaaaaagctggcacagcgttatcatgggggatactgccttgtataccgtttgtgtgtaaatcactatcatagatattgttatgtggattccgggcaaaagagtagaaacttttttattccaggacgtttacatacggtaagacccgttgccctccgggaagttcctgtatttactgagaatagcagagaatatacattaattcggacagaaaagtttggcacagtagtacagatggaagttggcgcaatgcttgttgggcggattgtcaatcatgaagaaaaaggaagtaccataagaggaaaggaaaaaggatattttcaatatggaggttctacaattatcgtactgattgagccagaacaagttcagatacgcgaggacattttacaaagttctgcactgacaaaagaagtgcccgtcaagatggggaggtcattggtcatgcactcgaacataaaagaacgattcaataatttactgccaaagtatgcaatcctgccgattatcgcagctttactcataaataactgtatctacataggtgcagcacaacttcgaaaccacttatctttttactcactggcaatctcgctagatgaaaagattccactgttgacaccatttgtcatattttatgtactggcatatgtccagtgggcattgaattacatattaattggcagagacagcaaaaaactgtgctatcagtttgtacttggagatattctttccaaagtcatctgtctattcttctttatattgtttccaaccacattaacccggccggaaattacaggaacagatatattcagtcagcttgttcgctttatttactctgtagatgctcccgtcaacctatttccgtctattcactgtttagagagctggtgctgcatacgtgccgcctacaaaatgaatttcaaaacagaaaagagaaccaactattatcgagtggcaacgattcttatgtcactggggatatttgcatcgacattatttataaaacaacatgtaattgcagatgtatttgggggaattgcagctttcgaaattggaatgattttggcaaaaattctgatttgtgaggatgcggagcagacgaactcctgaagataaatggtgtgcatcccgtcaagtagacaattaaaaaaatataaaatttttgtgttgcccggtcggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcgttaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagccttacttctgcccgcagtttttctacttccgtcatttcctctggggattttctctttccccgcttatcctgcagcccatccaccccgttttcttcatatcttatagtataacttctggcctgctgataagaaatgtgaaatttttttgctgtttccgaatagttatggaatgttttatgcaatattgaacgatctcgacacgttcttcaaatgtagtttttctgcctttagtcatgattggtctgcctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgaccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccaaaataaagcatatttgtgactttagtcgcggcggtttgaatgttcacttacagcgctcacatccaaaccttgctccgaggccacaaatatgctttatttatcttcaggagttctgcttgttggcagctcagaaaatcagttggagagaattggggaagaggacaggagatgtagaagttccgggaaatgaaattctataggattgacacttgaatcagtgccataatcgtatagttataatatcaaataatttaaaatgataagataagtgtcagtcctccagcatttcaattcctcaaaagattacaactgtctgaagcctccctcaaatctttctcaaaataaatcctgaatttgcatgggcagccaacaaacagtttccaaagagagccgataccctatatttgtggcctcggagcaaaggttggatgcaagcggttaagcgaacattcaacctgcagcgactaaagtcacaaatatagggtatcgtggtgtgcatcccgtcaagtagacaattaaaaaaatataaaatttttgtgttgcccggttggatatcgggcaacatttttataccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactatgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttcaattccgttacatcggtaacccatttctcattaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttcttcctttagtcatgattgctctgcctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgaccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttcaactgtctacctaaaagggagcataccatcggctctctttgcgggcgtctgtttcgctctacaaatcaggatttacaaatctatgcgttcaattgtttgttcttctatattatgtcgttttgtatatccagtaagaataagcgttaaagctccgtcgcccgttacattgcaggctgttccaaaactatcctgtaatgcaaagatagtaagcattaatgcagttccggaatctccgaatccaagaactcctgtgataagtcctaaggatgccataactgttccgccaggtacgccaggtgctccaatagcaaatactccaaggagtacgcagaaaagaatcattgttccaggtgttggtactgtgccataaagaattttagaaactgtcatgcagaagaatacttctgtaagaacggaaccgcacagatgaatatttgcaaacagcgggataccgaactgtaccatatcttttctgagtggtttacatttctcagcacactgcagggcaacagcaagagtagcagcagaagacatagttcctactgcagtcagataagcaggcccataattttttataatatctaatggattctcacctgaataaactccggcaagtacataaagcaaagtcatccagatgaaatgaccaactaaaacaataacaataactttaaggaaaacaggaagctgttttgtaatagttccttcatatgcaagtgagcagaatgtcagaccgataaaaaatggaagaatcggaatgatgattctcgaaacgatagcaagaacaactttctgaaattcatctaaaaaagctgcaatcaaatctgctttcgtccatgctgcagccagtccaagtaaaatagataaaacaagtgcactcataaccggcataatctgtggaatggaaagttcaaatacaacatcgggaagcgttttcagtttatctgctgccgaactgatagaaagatgtggaatcagtgcatatccggaaactgtagaaaatagtgcagcacctaatgaggaaacgtaagcaataacaatagcaacaccaagcatacgtgaagcatggctgccaagctttgtgatagaaggtgcgataaatccgatgataattaaaggaacacagaaattaatcaactgtcctaaaatatactttgcagttacaaccacatttaaaatggcccttgtcgcagcattgccatcggcataattaagcacaagcccaatacagatacctagaaaaacacccattaagagtttgaaaggcaagctggtaaaaaaattattcttgttcatacaaaaaatctcctctagttttctctccattatactatattgcaaaaaatataacaatggaagattctactatttaattcgttagacaaacagacgcctgagaagagaaccgatggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattcccataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaaggcttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaacgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaggcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccgaccgggcaacacaaaaattttatatttttttaattgtctacttgacgggatgcacaccaccgataccctatatttgtgactttagtcgcggcggtttaaatgctcgctttatgcgctcgcatctaaaccttgctccgaggccacaaatatagggtatcggttctcttctcgggctgtctttggctggattttgtttgaattaaatagtagttgtggagatttgggggagagggcagaaggtttctgcttactctaaaaatattatgaatagatacttagtatttaaatggatttgttaaagaactgagattgagaatagaagcctgtttcttgttctgaaattattgaaatattgctgtgacaatcgttaaaaaagctaaatcataccctctattccagccattctcgagtaagcagaatacatcagcttctgtccccaaatcccctccccctgtttaattcatcttctccagccacagcacagaagccattgcccccaataaggcatatttgtggtctcggagcaagtgttggatgcgagcgcataaagcgaacattcaacacgccgcgactaaaatcacaaatatgccttattgggggcaatggcttcgtctgtagtttgtctaatgaattaaatagtaaaactaaacatagtgatatttttttctttgcttgatgaagaaggtgatagttacgcataatgtcattaattctgcaattccgacagcgctccagattccattgattcccaataatgttggaagtaaaaggatcataataatctggaagaccagggtacgcaggaaggaaattgcggcggatataacaccgttgttcagtgcggtaaagaaggaggaaccgaatatattgaagccattaaccaggtaagcaagacaataaatgcggaaaccgtgttctgtcatggcaaaaagttctgcatcgtatccaacaaaaagtttggagagaggagcggcgagtagctgtgagagtagtgcaagcatgattccccatgtacctattaagcaaaggcttttcctaaatagatttttaagttcgtcctgattcccagcaccataatgataactgataaccggcgcacttccaatggaataaccgaaaaatattgcaaggaaaatgaagttaatgtacatcattgtcccataagctgcgactccattttcgccggcaaatttcataagctgtatgttataaagtgagttcataatggaactggaaagattcgtcataagctcagaagaaccgttaatacaggtctgtaaaagcacatgaccgttccagtgggttttaccaagacggagcaagctggaatttttccttgtaaaataaaaaataggaaagagtccgccaataaattcgccgcatactgtcgcaagcgcagctccggcaagtccaaatcctaaaatgccgacaaatagaaaatcaagtaccatatttgtcacaccagctgcaatgacaacgtaaagaccaagatgcggtttttctgctgtaacaaaaaagctctggaatacattttgcagcataaaggcaggcatggaaataaaagaaagtctggcgtataaaatgcagttagaaagaagctggccttttgccccgagaaaggaagcaattgccgggatgaaaattgttccaagaatggataaaaggataccgccgattgccgtcacatagatgagcatggaaaaatattcatttgccttttctctctttttttctccaagcatcctggcaacaattgcgctgcctcctgtaccaatcataaatccaagagcggataatcccattataattgggagtgtcagattaatagcagcaagagctgtcttaccaacgaaattagatacaaaaagtccatctaccacactataaatcgaagtgaagatcatcatgataatagagggtagaacaaaacgcaataattttttataagtaaaatgttcggataattgaattttcataaaaactccttgatacattgttatttaaggtaaaatgtttatctaatttcttaagtttaaagttttgaaaacttttcccgcaatgcagtagtatatttactatgtaactttagcaataaattacattcttcgaaacttaattcagtaaaagcttcattttctgcttctacgataggaaaaatagtctcttttaataaagtatgtccactttccgtcaaaagaatgtgcttgctgtggccttttccattagaaagagtgagataaccttcttgttctaatttacgaatagcggagttaacagtctgctttggaataaaagtagcatcgcagacatctttttgcaggcagccctccccgacttcgcagatggtatataaaatgtcaaatacgctgttggaaagcccgaattttgaagcagcatctcggtaaatatcattcacttctttataaatacgattatattcccgtaaatttgaactcatatatggagtagtggaaaaattatctttcataaaaaattcctttcataaaaaaagtatgatttcgtacttacggtattatagtacgaaatcatacttaagtcaagagcgaaaatatagtacaataggaatttgtcagtgaaataataattaccgcaggcaagaagacacactcaaagagagcaggtatcctatattttgactctatcacttgcgggttaaatgttcgcctccgcgctcacattcaatcctcgttctaaggccacaaatataggatacctgctctctttgggtgctgtgttttggccggagatggaattactatttcatgttggagtgattggggaatcgccagaagattatggccttttaaaaagttgagtcataagagttcgatacttatattattgttttaatgtgtaaaaataataatttttcttatggatttctgtgtcaattctttgaaatttagtttcccagatagctttattctcctgtcttcttccccaaatcttttaataaatttgccggattgaaacaaccagaacccccagagaaaatataccctatatctgtggcctcggagcaaggtttggatacgagcacttaagcgaatattcaaaccgccgcgactaaagtcacagatatagggtatattttctctggggttcgtctgtttactcaccccggcaaattcctatttatccttccataatccgtggagattgcagtattcgtaagctgctacaaattcatctccatcagctaatgtaaatgtagccttcggagtatctcctggctggaatttatggagctgtccaccgttctttgtttcgatatatacgcccataatataatgttctggaagcattggatgttctacggaggaaacagcaacggtaatcttattaccttcctgtgttactacaggaacgtgtttctctacagcggcatctgttgtgttcgcttttaaattcttaaggttctctacagaggaacctgccccaaataattctaataatactgttctgtcttctgtacgataaaatttagccatgtgttcttctccttttctaaaattttaatatggttataatacctcttgtaaataaaaatagtaactattactgtgattagattataacccatgagaaatgaaatgtcaatataaaaatacctgtattattctatgatttttgatggaaaatcttaaaaaaacgtgataatatctctctgtgagtttttcagaatgtatttcaatctgtttaatggtaaaaatagaagtttgagaatgataaaaagttataaaaatgaaagggtaaatagatggatattacaataaatgagttaggacaattaacgccagacagctatatattacttgatatgcgtggagatgtagaagtaggacacggaatcattcccggagcaattcatatgagcaaggaagaaattttagaaaaatattcgggtggacttgtaaaagcagatgaggcagaggcggcagaaagagaagattctgcggaaaagaagctgattatttactgtgcgcgaggacgtattagtcaggaacttgcagaagaattacgcgatagaggatatgatgcatatagtttaaaaggcggatatacttcctggttgttaaatgaaatgaagaatcagcaggcagacgaggtatgtgcacaggtagagaagagtatccgaaaaaagtttcgtaagaatatctggtgtaagtttacaaaggcgattaatcagtatgaacttgtaaaagaaggagattgtattgcggtatgcatttctggcggaaaggattctatgctgatggcgaagctttttcaggagttaaaactgcataataagtttccattcgaggtgaagtttgtagttatggatccaggatatagtccggaaaacagaaaggttattgaagagaatgcaagaaaattaaagattcctattcatatttttgaatctgatatttttgaatctgtatatcatattgaaaagtctccatgttacctctgtgccagaatgagaagagggtatctctataattttgcaaaggaattgggctgtaataaaatagctctgggacatcattatgatgatgttattgagacgattcttatgggaatgctttacggcgcgcagatccagacgatgatgccgaaacttcatagtacgaattttgaggggatggaattgattcgtccattatatcttatccgtgaggatgatattaaggcatggagagattataacgatcttcggtttattcagtgtgcatgtaaatttacagatacttgtacaacatgtaataacgaggaaaatcagtctaagagagtagagataaagcagcttattgcagaaatcaaaaagaaaaatccatatgttgaagcacatatctttaagagtgtggaaaatgtaaatattgaaactgttatcgcctataaaaaagatggagtgaaacatcattttttagataattatgatttgtaagggaatatgttacataggaattgcttattattttaaacaaaaacgggtttaaattgtgtttgtgtaaaacataatttttctttcctttctttgatatccttgcatttttatgataaaattatcttcaaattatacatttactatatataaaaggagaacaatcatgccagtatttgattttagtaatatgcaggctaaaaaagagcctgtacgctgcacatacgcgatggtttactcagataatgaccatgcttcaccggaaaatccaattcttgtgatcgataatcaaaaaagagaatggaaacatcattcctttggtattttcgcaaatccaaataaacagacaacttttgaatttgaagaagaagatggcacaatcagcgcagatatcttaaaggttgatgcccgttttgtcagtcttttaaaatggcttggcgaacatcatattcacgttcagctttctggtaaaaatgttgaagagggatatgctgtttacaaaattcaggaaatttcttttggtggaagaacaaagttatctgcagaagatggatttttacagtttatgattgaacgtttatttgccagtcctgctccagcagaagaagtaacagaagaagtggaggaggaagacagcgatgagatgaaacttaccagtctccagagtatcactgacttcatgacctgtgccggaagaacacttcctgacaatatccgtctgtgggccagaagaaacctggctgttgcccgttcccgcgaagtttcaccagaagaaagacgtcatgcccagcgtgctttgtccatcatgatgaatattcagtggaaaagtgattattttaaatcaattgatccggaagaggccagaaaaattctcgatgaagaattgtatggaatggagcgcgtaaaacagaggatcatcgaaaccattatccagattaaccgtacacatacgcttccggcttacggtcttttacttgtaggccctgccggtaccggaaagtctcagattgcatatgctgttgcccgtattttaaaacttccatggacgactttagatatgagttctatcaatgatccagaacagttaaccggaagttcccgtatttatgccaatgcaaaaccgggaatcatcatggatgccttttctatggccggagaatcgaatcttgtatttatcattaacgaattagataaagccaattctggtaagggaaccggtaatccagcagatgttcttcttactttattagataatcttggatttactgataattacatggaatgtatgattcctaccgttggtgtttatcctatcgcaacagcaaatgataagagccagatcagcagtccgctgatgtcccgttttgctgttattgatattccagattacacgccagaagaaaagaaagcgatcttctccaaatttgcgcttccaaaagttttgaaacgaattggacttcgtgagggagaatgtattatgacggacgatgcgttagatgctgttatcgacattttctctgatacaacaggtatccgtgatttagagcaggccgcagagcatattgtggcaaatgcgctgtatcagattgaagttgatcatttagaacaggtgacatttactggagaaatggtaagagagttattactttaaattctggtttgccgcaggcaaaggaggcttatacaaaggcaacaaaggtgatagtaaaataatttgagataaagaggtgttttggtgaaaaaaagatggtttgctctgtgtatgtgtattgttatgctcgcaggaatactaacgagttgtggtacaaatacagggaaaattaaatttggtgcagcaggtcttggtggaacgtatcgtgtatttggtgatacgtttgcaaatctggtgacatcaaaaaataagaagtacaagatggaagtgaagacaacggctggttctgcagcgaatcttcgtctgctttcggatggttatatccaaatggcggttgcacagacagacttaacaaatgatgcctacgagagaacgggtatttttgagaatgaaaagcagcatggaggttatagtgcagttgctgcattgtatacagaagcgtgtcagattgttgtaaaggcagattcctctattaatacggtagaagatctgcaggataagagagtcagtgttggtgaggaagagtctggtacagagcagaatgcgaagcagattcttgcagcgtatggtcttaatgacagtctggttgatgaggtgaatcttgactattccaatgcagcggaagaacttagagaaggtaagattgatgcctttttctgtaccgccggagcacagacaacagttattggagaacttgcaaagaaatgtgatattcgtcttctgagtattgatgagaagagtgcggaaaagttaaagggaacatataagttttatacggactgtacgattccaaaagagacgtataatggacagacagaggatgttaagacggttggtgtgaaggctgtgcttcttgcaagtgataagctttctgctgatacagtaaaagatattacaaagattttatttgagaataagcaggaattacagtatgctcttccagtagatatttcgcttgatgagaagtctgcggtggagggaatcacgattccgtttcataagggagctgtggcatattatgaggaatgtggtatggatgcagcagaactaacaacagagaaagagagcaattagtggccgaaggtaatagtttatgaagattcaattagatatgtaccagacaattgccgtagcggtagttgttctgatgttaggaaagtttttaaaagaaagggtggaacttttagagaggttctgtatccctgcgccggttatcggtggtgttatatttgcgatttttacctgtctttgctatgtaacaggtatcgcagaattttcttttgatgatattttaaaagaagtttgtatggtatttttctttacatcagtaggattccaggcaaatttaaaggtattaaagagtggaggaagggcattgatcgtattccttggactcgtaatcacacttattttatgccagaatttccttgcaatcggacttgcaaagcttttacatatcagtccgcttgtaggactttgtacaggctctatcccaatgatagggggacatggaacagcaggtgcctttggtccggttcttgaagacttcggggtaaagggagcaagtacgttatgtacagcagcagcaacatttggcctgattgccggaagtgtaatgggcggaccagttggaaagcgtcttattgagaagaaaaatcttttagataccgttgttgtggaagatgatagtcttttaattgaagatgagagaaagcatgaacgtcatgcaagtatgtatccagcagcagtatttcagcttatcattgccattggtattggaacgatcatttctaagctgttatcacttacaggaatgacttttccgatttatatcggagccatgattgcagcagcctgtatgagaaatattggagagtattcaggaaagttcacgatttacatgggtgagatcaatgacatcggaggtatcagtctttcccttttcttaggaatagcgatgattaccttaaagttgtggcagcttgctgatttggcacttccactgattacgttgcttgctggacagacgattcttatgttcctttacacatattttgttgtatttaatgttatgggaagagattacgatgcggcagtactctcatcgggagtttgtggattcggtatgggagccactccaaatgcgatggcaaatatgcaggcagtatgtgagaaatacgcaccatctgtcaaggcatttttattagttccactggttggaagtttatttgcagactttcttaacagtttggcgattacgttttttataaactttttataattattaagagctgtcaaatgagtaatgaatatgtggattgttcagaaaattaagcgggaatctttggtgattcaattgccagattcttcacttacagagcttaataattataatttttacagtatgaaagagggattttttatgtttggtaaaaagaaaaaagtaaaacacgcagagcgtcatgtagattataaagtatctagtgagaatctggctatgccagaacttcatattggagaagataagggtgaagaacagcctgaaaagaaagacgatggatttattacctatgagaatgtagcaattccagaggtacatattaaaaaaagaaagtaagcagggcaatatataagagggaagaatattgcagaattaatagatttcagagcgtggaaaactttttctgttttatgaaattatcacaattttcttccggagcatttcttaaacacgctctagagcgtgtttgaaaaatcattcctgcaatctgcacgtcccaatttgcggtatattttgtcttcattcagttgacgtagcccgctacgccgccctcattcaggcgaaatctcccacaaattgtaacgcacatcttacagaaagcatttcttaaacacgctctagtccggtaaactcaatatctggcagaagttcaaagtaaaagtcaggatatttctttgcaagcgcaagaatacattcatcttgaagaaatttgaacttggatagggaaacaatgtctttatcaaaggtgatatagacactgacccagagttttcgtccggttcttacaatatcataataaagatttttgtgaccgtagataccaataataggttctacggttgctttaatatcctcaatagtttcctcttccggtggaattagcatcagatcacggaatccggtaatgattgtgtggattggtgcaggaatcataataagggacaaaacaactgtaataatctggtcgagataagggacaaacttctgaaaccatgcaaaaggaataaacattggaagcaaaaaggcacaggccataccaaaagaaacaacactgtccatgcgccagccctgcatttccatattaataagaggggattgcattgttttattttttatgtaaagataaactgtaacgataattccaagaacacaggcaaaaagttcaaaatatgcgacagtgttaaatgaaattatatgcccgccatgaatcataaggttaatattattaaaaattaatccaaaagtaacggctgtcatcgttataccctttattacaataaataaggtctctatctgcgtgtatccaaatggatgctgttcatttgccggccgataaagaaatggaatcagaaaaagtgatggcagaagcatcacaaactctaccccgtcatagacagcatcaagcaaaacagcctgggaactggttacaattgccatgataagttcgattacgacaaaaagtaagttgccataaagtgagacagacatcgctgacttttctcttttttgtgtttttcgtcctacatgcatgataatcctcccaaagtgtggtatagtagtaactctgaataattataaaagaaattaaaagaaaaggcaaattaaaagaaattttgaaagtatttttttaatatgtcctgaaaaaggagagtaaaagatgtcaaaaacgacaattaacgatatgaccatcggaagtccggcaaagctaatcatcaagtttatgataccgatgtgtctgggaaacttattccagcagttttataatgtagtagattccatcgtagcaggacagtttttaggagtacaggcactggccgcaattggaagtaccggttctttgatgttctttgtcattggctggcttaatggcctgaccagtggatttgcgattatggtcgctcagtcttttggtgcaaaacaatatgatagaatgagacattatgttgcaatgtctatttatttatccgttgcatttgcccttgtaatgacgataggtttttctgtcgcaaatgaacagattcttcgcctgatgaattattcggatgaaatcatgccctctgtaaaaggctatatgggaattatttatatgggattgcttgttacggtagcctatgatgacctgtccgctttcttaagagccttgggagattcccgttctccattatactttcttatgatttctgcgggtatcaatgttgtacttgatattgtactcatcgtagtgatgggaatgggtgtagagggctgtgcttatgcaactgtaattgcacaggcaatttccgcactcctctgttttatttatatatgcaaaaagttcccaattcttcgattaaagaaaacagatttccagattgcattaaaatcattaggcaagttattaggccttggtatccctatggcattacaattttccattactgcaattggaacaatcatcgtgcagggagccatcaatatttatggagaaaactgcatggcaggattctctgctgccggaaaattacaaaatattttcatgactgtctttgtagcctttggtgcaacaattgctacctatgtcggtcagaaccgtggagctggtaaaatggatcgtgtaaaacagggagtgcgctgcacacagtatatgatctggggatggagtgttgtaaacatgattgcaatgttcttctttggaaaatacatgacttatctatttatcagtccgtcagaaacagaagtaattaaagtagcggttacctatttccatactgtattctggttttatccgttcctaggaagtattttcctttacagaaataccttacagggaatgggctacggattaattcctatgattggcggaatctttgaacttgtagctagaacggcaatagtaaccttagtagcgggaaaaaccagctttgcgggtgtttgtatggcagatccagcggcatggctggcagcattggtaccgttacttccatattatttctacataatgagaaaatggaaaaattctgatttgttgaattggcaaaactgacgaaacatcgaaatcccatcgtccatatttgtgattttagtcgcggcgcgttgaatgttcgcttatgcgctcgcatccaacacttgctccgagaccacaaatatggacgatgggatttcgatgtttctgacagtggtttctgaagtaaaatcagaaatcatgttgaagagatttggggattccccgaaagactgtgattttatgagaaaatatagtgaatccataacagtatattaaaaaaaatagtatttaaattcgattttttaaagtttttatagcggatgtttactcatacagcaacaaatcggtgaaaaaatttgagaaagtgaatcagagtaatatttttttatactatgttacagagaagctaatttttttgcaaattcataatattctggagaattcccaaatctctaacgtgaattctgattttgtgccagcatccacagtcagcccgcaaagagagcctatcccctatatttgtggcctcggagcaaggtttggatacgagcgtgtgtaagcgagtattcaaaccgccgcgactaaagtcacaaatataggggataggctctctttgcgggcgtctgtttcgctctacaaatcagaatttatttcgctgtggcagtcttcttatgtgtagctttcattttatcatactgggcaaataatcctgccagtaatgttcctgaaatagaatgccatacacaggaaacagcacagatgatagcagactctggtgtagaagcaaactgtgcagttgttgttgcaaggtttgttgcaagaccggcattctgcataccaacttcaatagaaatggttcttttctttgctgtattcatacctgtaaggcggcctgcacagtatccaaggaagtatccaagaccgttatgaagaagaacagcaatgaagattacggcgccggactggaagaattttgaaccctgagaggagataaccccaccaacaacacaggcaagtccgagaacggcaacacccggcataactttctgaagttctttaaatgtcttattctttcctaatgcataatttaatacaaaaccgatagctactggtacgataacggtttcaatgatagaaacaaacattggaagaccgtggatagtgattttagctccgctcgccagaagagaaaccataagtggtgtcataactggggagaggatagtagatactgtagtcattccaacggaaaatgcaacatcaccaccgcagaggtaggacatgatgttagaggacacaccacctgggcagcagcctacaagaatcagtccaagagcgatacctgttggaagatgaagcagttttgtaatgaaaaatgctaaaaatggcatgattaaatactgagcaatagcaccgatgcagatatcaaatggtctttgtgcaaggatcttgaaatcctctgttgtaagagtaagtcccatgctgaacatgatgacaccgataatgatagactggctagtgaatttatttgccactgggtcagtgaataactggaaatttacccatcccatcagtgatggaaggaaaaatgtgattactgcgatagcgattacaacgattgatgtgtaatcagataaaaatttgctgaacttttgtaattgtttcatacttgtgttacctcctgatgatcctcaccgcttttcttttattcgttgtactttttaagaaaacaaaaagtcccttctcagaaaaaactgaaaagggacgaaaaaatccgcgttaccacccaaattctgtaataaaattacagctcttaacgtactgtcatacgctttccttttaacggaggattccggcgagacctactgattagaaaaaataaaaaatgtcagataatgttcagtctgcatcttagagaggatatctgttattgaaaatgcacctgctcacaccaaccgcaggctctctgaaccattctgttcaaaaacagcgttgttctcttcaacgaatttcggtgaagttatgtatttgacgaacttcattatagtccgatttctaaaaaagtcaagaagaaaattgtcctaattttcgtacattgtcaaaatgttgattcaagacatattttgaaggagggatagagtgtgcttgaaaaaacttgccataacattttataaatggtataataaagcagaaaatttgcaggttttgataactgggcctgcaaaaaataagaatggacatttatgaaaaaatttacggaaattcacggtaattcaatgatgagattttgaagatatcgaaggcatgaagagtattctggatatcgaattcatggtaattcaatcgtgggagtctttacgaaaaaagataggaaagaaggaattttaatgtttaattttttaaattcagaaagcctctggataggaacagatatgaaaaaatttaatgaaatccgcacacaattagagaaggaaggaatcccgtataaatataaaacaaaagaccatttatcacagacgatgtacccggcagaaggaacattaagaagccgaacaggaagttttggaaataaaccagaccagatgatagaatatgaaatcctcgtacataaaaaagactacgaaaaggtgagaggaaaattctgatttgcgcagcaaaggagacgcttcccaagaaagccaataccctatatttgtgactttagtcgctgcagattgaatgttcgcttaaccgctcgcatccaacctttgctccgaggccacaaatatagggtatcggctttctttggaagctgtttgttggctgcccatgcaaactcagaatttattttgagaaagatttgagggaggcttcagacagttgtggccttttgaaaaattgaaatactggaggactgacacttatcttatcattttaaattatttgatattataactatctttggaagatttccgggttttattcatttgccttataacttttttgctttttttagcatttttaccgcaaattggagcgtgcggattgtaggaatggtttttcaaacacgctctagttaatagaaaaaagtagtaaccataaataactatacgattatggcactgcttcaagtgtcaatcctataaaattttatttcccggaacttctacatctcctgtcctcttccccaaatccctccaactggttttctgggctgtcaacgcacagaactcctgaagcgaaataaagcatatttgtggcctcggagcaaggtttggatgagagcgctttaagcgaacattcaaaccgccgcgactaaagtcacaaatatgctttatttcgcttcaggagttcgtctgctttgcagtctcacaaatcagaacttgctccgcaagtatcccggattgtaatttcacagggaagagtcatcctcaccggcatattgtaggaaagcttcgtattactttctgccagaagctgaatataatgcgccgcaaactgtcccataaaatcagccggagcatgtaccgttgtcagtggcggattagaaaactttgccacgttaatatcgtcaaatcccataacagaaatatcctccggaatgcggtagcctttctggtaaagggcgcgcatcgccccaatagcgatagggtcgctggctgcaaaaacggcacttggaagtgttcctgcttcgataagttccatcatcatctgataaccggcatctgcagaaaactctgtttcttttaagtaaggttcataagaaatctggtgttccttacaatagcggataaaggtatctttcctctgttcaaaataaaccgtatcatcatttaaatattcttttccaccaagataagcaatggaggtatgtccaagactggtaaggtagttgagggcatctacaactgcctgttcaaaatcaagcgaaatcgtgttacagttgatttttgaagtctgcatatcaacgaaaatgacgttaggagtgatagattcaaatagttgaatctgtttatcgttaaacttgccaatacagattagtccctgcacgccccgaagggtgttcatgtaatcagggtcactctgaaaggcgcggcggatttcgagattctctgtcatacaataccgctcgattccacttcgaatcgcctgataataagggtcttctaattcctgaaataaagtaacccactgaaaaatcccgataaccgttttggaagagggggaagatttttttttataatttaattcgcgggcgatttcctgtacccgttctctcgtttgtggagtgacacttaatgtctcatcctgattaagaatacgagatactgtggcagaagatacaccagctctttttgcaatatctttaagtgttgccataataagactgactcctttattacttttgtaattttacaatatatttgtaatatttttgattgcaattcatcgcatgtaaagtattttaacacattctggaatactttttcttctgaataatcatagtataccaaattttacagaatagttgaagaaaaaattactaaaaataaagtaaaatgtttagtaaaaatttacccttgcataatttactaaaataatttactatataagcaacacgaaaacaaccactaaaatatcagatggtaagcgtgatagcaaagtatagtgatagtaagaaacaggaatgaaaacaggacggctttaagaaaaggagtaggaaaagatgaagacaacagaattaaaaaaagggtttcaggacgggaagtacgaggagttattaagagatatttacattgatgaatctgttttagactaccagaaagaacgttatatcaaagcaatcgagagctttgaggaattatttggggaaaaagaagtagagatttacagtgcaccgggaagaagtgagattggtggtaaccatacggatcatcagttaggaagagttcttgctgcatcgattaacttagatgcaattgccattgtagcgaaaaaagagaatggtgttgttttaaaatcagaaggctatccaatgatcaatgtttctttagcagaccttcttccaaagaaagaagaagagggaacttccgaaggactcattcgtggtgttgctgcaaagttaaaagaagaaggttatgaaatcggcggttttgaagcatacgttacaagcgatgtattaaacggagcgggaatgtcatcttctgcagcatttgaagtgttaacagggaacattttatcaggactttataatgagggaaaggtttctccagtgcttatcgcacaggcaggacagtatgcggagaacgtattctttggaaaaccttgtgggctgatggaccagatggcatcttctgtcggtaaccttatttttattgattttgcagacgtgaagaatcctgtaatcaaaaaagtaaatgtgaattttgaggacttcgaccacagtttatgtatcattgatacaaagggctctcatgcggatttgacagatgagtatgcagcaattccagaagagatgaaaaaggtagctgcttattttggtaaagaagtattacatcagattgataaaaatgaattttatattcatatcccagaaatcagaaaagtagcaggtgatagagcagtccttcgtgcaatgcattggtttgaagagacagaccgtgttattgaccaggtaaatgcattggaaaaagaagattttgaaggatttaagagcctgattaaagcatctggcgattcttctttcaaatatcttcagaatgtatattctgtaaagaatctttccagacaggagatggcagtaggcctcgcatttagtgatgtaatcctgaaaggaagaggagtgagccgtgtgcatgggggtggatttgctggaacaattcaggcatttgtcccaaatgacattgtagacatttacaagaaaaacatggaagatatttttggacaggatgcctgccacgtattaaaaattagaaaatatggtggaatgaaggtattataggataatattaggaggacagaaaaatgggactgacaaagaatatcaagaagcttgtccattatggtatcggagcgaagctgattcagccagaagacgagattttcatgattaaccagtatcttgatttattcggtttggatgaatatgataatccggatattttcggagaaaaaatggtgcttgcggatattttaaatgaattgacagatattgcatttgaaaagggaatcattcagagtgatgatattgtcacaagggatttgtttgatacaaagctgatgggaattatgactccaagaccaggtacagtaaaaaagatttttgatgcctattatgaaaaaaatccgaaatatgcaacagattatttttatgaacttagccagaacagcaattacataagaaaagatcgtatccagaaagatatgaaatggacagtggacagtccctatggcgttattgatatcacgattaatttgtcaaaaccagagaaagacccgaaggcaatcgcagcagccaagaatgcaaagcagagtgcatatccaaagtgccagctttgcatagaaaatgaaggttatgcgggaagaatgaatcatccggcaagacagaatcaccgtattatcccgataaccattcacggaagccgttggggatttcagtactctccatatgtttattataatgagcattgtattgtcttaaatggacagcatactccgatgaaaatagacagggatacctttgccaaattatttgactttatccgtcagttcccacattattttgtcggttccaatgcggatttaccaatcgtaggaggttctatcctcacacatgaccattttcagggggacattatacctttgcaatggaacgggccgaaatggaaaaagaatttaaagtgcccggctatgaagatgtaaccgcaggaatcgtacactggccattatctgttatacgaatccgtcataaagacccggaacgcctgatagaccttgctgaccatattcttaaaaaatggcgcaactacactgatccagatgcatttatctttgagcagacaaacggagaaccacataatacaatcacaccaatcgcaagaagaagaggggaagaatacgaactcgacctcacattaagaaataacatcaccacagaagaaagaccactcggagtctatcatccaagaccagaatatcatcacatcaagaaggaaaatatcggtcttatcgaggttatgggacttgccgtacttccttcacgccttaaaaaagagatggaaagcctcgctgactgccttgtaagtggaaaagacgtttcctctgtcggaggactggaaaaacatgctgactgggtaaaagacttccttccaaaatacgcggaaatcacacaggaaaatgtgtgggatatcctcaaagaagaaattggggaagtgtttgtaaaagtactcgaagatgcgggagtgtacaaatgtactgaagaaggaagaaaagcctttgaacgcttcatcaatactttataaattgtgatttgccgcaggcaaagagacgttctcagagaataaaataacctatatttgtgactttagtcgcagcggtttgaatactcgcttatacacgctcgtatccaaaccttgctccaaggccacaaatataggttattttattctctgagagctgtctttggctgcccatgcaaattcagaatttattttgagaaagatttgagggaggcttcagacaattgtgaccttacggggagttggtctgtttcgctctacaaatcaggattttgtgtaaaatgcagaatagaagccggtttttgcccaaatatctcaataagtgcgctggccttttcataagcaatatcaacagcctttttcacagcaccataatctccgctcactccaatgattacttcgttagtatgagacagattaatggaaggtgttccgtaccacacgatatcgactggcgaagactttacagcagtgtctgcagcaacgatagcaattccggcgggaccggcacagatgaaaccgaaagctttgccaagtggtgcatcaaaaatctggtgaagtactgggccggcattggcagttacatgcatttccatgtgaccaacttcattgatgtaaattcgttccgctttttcatcaattagtgtaagagcaacttctacggcacgtcgggcatcgctcacataataagctccaagtacgattaagttcccgtgaccagagtagccttccgtatctcttggcaattcaaagataagaagttctacattacaggcttttgcagcttcatctacagaaaatgcctgtgcggcagccccggttcttgaagtaagaattcccagggaagaatattgctctggaatctttaaaagagtccgcacttctgggtcaatattagggataaccatgccaatggtgtgccctgcggccgttccgataaattcatttgttgtgggggtaaattctgcgtgactcataaaataagtgcctttctccatagtaataaaatgataacgttctgtaataagtgaggttcaaaaaaacccacattctgtaaatattgtatcgcagaatatgggagagataaatggaaacctttgcactgaaaggatatctttttataatgattttttatagcactgcagatatcttttctcttttactctcttacagaaagtatttttcaagcacgctttaaattttttcaatctcttttcgcaacttcagcatttttttatcaatctttgcaatgtcaattgcacattcctttaattcttttcgaattcgttcagcaccttttttctcatttttatagcaaagctgatattcaagaatcgcccagtagttcatggcggcagaacgaacctgaatctcaatatagttaatgtcatatgcggtatttgctggtcttaaaataagatgaatactgcggtaaccgctggcttttggtttgttaatataatttttttcttttacaagctcataaccgggaagatttttaattgctccagccacacggtatacatcatcctgaaaagagcagattacacgaataccggcaagatcacgcagagtcgctacagctttatcaagagaaacctctctgttcttgcggtgtaatttttccacaatactttccgggcttttaatccggcttgtcgtatattcaataatatttcgatgataagtgccggaaagcgagcgtccaagccttttaatctgcggcatcatctcatcaataagcagttggcattgttcctctatatgatgctgcttcatagcctcttccatagcagctacttctttttgcaacttcgtccccgtagaccccatctgttttactggtttaaccttcttctttttcacttacgttcattccctctttcttcttaaaaaaatatggcagatattccaaaataatttgcagaaatgtttcttagctctttttatgtatatagtatttttataatgtaaatgcaaattatgtagaattcatactaaatgtgctattcacacatacagttttagtatacgccacctgccgacatttctctagcagatatttgagaaaacggtgtaaaataggagtaaaaaaacaagagagtacataacagatgcacaaaatgcattaaaacgaattaatgagattcgatatgaggcctgtgaagaaggcgtgtggaaaatggacagctatggcaatcctactacggaaaaattaactgtatctgattataacctcattaaatttaatttccctttataacttccatttaaatacaaaatatctattcacaataatttcagagcaagcagaaaacttctgccctctcccccaaatccccacaaccactatttaattcaaacaaaatccagccaaagacagcccgagaagagagaagatatcctatatttgtggcctcggagcaaggtttagatgcgagcgctttaagcgagcatttaaaccgccgcgactaaagccacaaatatagggtatcttctctcttcttgggcgtctgtctaatgaattaaatagtaatcacactttttactttcattttacaaaactttggttttgaactttacatttgcccagtattctttagaggaagcttgaggaaagcaagcttaagaaagaagaaaaagaaaagaaaaagaaagtaagaaagaaggattacaatcatgaagaaatttatcagcttcgcattaattgcagctatggcagtaacaactcttgtaggctgtggaaacaaaggagcaaaagcagatggcggaagttccgatgcagcaatcactgtaatgtcaagagaagacggttccggaacaagaggagctttcatcgaactgtttggtatcgaagaagaagaaaacggagaaaaagtagataagacaacagacgaggcaagtatcacaaacagtacttccgtaatgatgtcttccgtagcaaatgatgccaatgcaatcggttacatttccctcggttctttaaatgatacagtaaaagctgtaaagattgatggtgcagaagcttctgtagataatgtaaagaatggcagctacaaagtagtaagaccttttaacattgtattaggaaagaaaacaagtgatgcagcaaatgacttcgtaaattacatcatgagtgcagacggacagaagattattgaagataacggatatattccagttgacgaaggtgcagcagcttaccaggcaagcaatgcaaaaggtaaagtagttgttggtggttcttcctccgtatctcctgtaatggaaaaattagtagaagcttatagtaaggcaaatacaaatatacaggtagacgttcagacaacagatagtacaacaggtgtttcttctacagtagaaggttcttatgacattggtatggcatccagagacttaaaagatgatgagacagctcagggtgtagagggtaagacaattgccaaagatggtatcgcagttatcgtaaataatgaaagctctgtagatgaattatccacagatcaggtaaaatcaatcttcactggtgaaacaacatcatggagtgatatcacaaaataaaggagtgggcagacatggcaaaatctaaagaaaaaatcatggaaatcgttttcctcctcgctgcctgtgtctccattctcgctgtagcattaatatgtgtattccttttcgcaaacggaataccggcgatgaagaaaatcggctttgccgattttcttcttggtactacatggaaaccgggaaatgatatttatggtattttcccgatgattcttggaagtatctatgttacagtaggagccattatcattggtgttccgattggattacttaccgctgtttttctggcatggtattgcccggaaaaaatatataaggttgtaaaaccggcagtagagcttttagcaggtattccatctgtagtatatggtttctttggtatggtaatgatcgtgccagcaatccgttacaactttggtggaacaggaagcagtattttagcagcttcgattcttttagggattatgattctcccaacaattatcggtgtatctgagagtgcgattcgtgccgtaccaggaagttattatgaaggttctctggcacttggcgcaacacatgagagaagtgttttcagagctgttttaccagcagcaaagtctggtatctttgcaggaattattcttggtgtaggccgtgcgatcggtgaaacaatggcggttatcatggtagctggtaatcaggcgagagtaccaaaaggtattttaaaaggggttcgtacactgacggcaaatatcgtaatggagatgggatatgcagaaggtcttcacagagaagcgttaattgcaaccggtgttgtgttattcgtgtttatccttattatcaaccttgcattttctattataaaaatgcgttcagaaaaagagtagataggagatgagtaaataaaatggaaaatattcagcaggcagcaaaaccaagcgctatgatgaacgaagctcctatgaaccatctgacattaagtgacagattaaagtcatataaaaggacaccaggttcttttcttgttatgttgctcgtcgttttatccgcagtcgcaacaatcgcagcacttgtatttttaattttgtatattttagtaaatggtatcccgtatattaatgcagatttattttcctggacatatacttcagaaaactgttcggtaatcccggcagcgatcaataccgtaattatggcaggaatatccctgttactggctgttcctgttggaatcggctccgcgatctatcttgtagagtatgcaaaaaaaggtaacaaattagtaaaggttatccgtgtaacagcagaaacgttaacaggtattccctctatcgtatatggattattcggtatgttatttttcgtaactgcattaaaatggaagttctccattcttgcaggtgcatttactttagcaattatgattcttccagttattttaagaacaacagaagaagcattattatccgtaccggattcttaccgtgaaggtagttttggacttggtgcagggaaacttagaactatctttaaaatcgttcttccggcagccgtaccaggaatcctttctggtgttattcttgcaacaggaagaatcgtgggagagacagcagcattaatttacacagcaggtaccgtagcaaagattccaaacagtgcattttcatcaggaagaacattagcagtacacatgtacttacttgcaaatgagggacttcatgtaaatcaggcttacgcaacggcagtaatcttactgatacttgttatcggaatcaatgcattatcttcctttattgcaaagaaaatttctaaagcataataaaaaaggcaaaacacaaaacgatatttatgatatttttcagaaaggcaggacaatatcttggcaaataaaatgatgattgatgacctgaatctgtattacgggcagtttcatgcattaaaagatatctctttaaatatacaggaaaaagagattaccgcattcatcggaccatctggctgtggtaaatctactttattaaaatctttaaaccgtatgaatgacttagtagagggatgtaagattaccggtcaggtaacattggacggaacagacatttacagagatttagatgtcaatcttttaagaaaaagagttggtatggtattccagaaaccgaatccattcccaatgagcatttatgataacgtagcttacgggccaagaacacacggaatccgaagcaaagcaaaacttgaccagattgtagaagaagcattaaggggagctgctatctgggatgagttaaaagaccgtttgaaaaagagtgcgttaggtttatctggcggacagcagcagagactttgtatcgcaagagcattagccgtaaaaccagaagtattattgatggatgaaccaacatccgcacttgatccgatatccaccattaaaatcgaagagctggcacaggaattaaagaaagattacacaattgtaatggtaactcataacatgcagcaggcaacacgaatttccgacaaaactgttttcttcctgttaggggaaattattgaggcaggaaagacagacgaattattttctatgccaaaggacaaacgtacagaggattacatcacagggaggtttggttgatatgcgtattcgttttgatgaacagctgaaacagcttaacaaagaaatgatcaacatgggaacaatgatcgagaaatccattggagatgctgtaaaagcattaatgaaacaggatgtagaacttgcccaaaaggtaatggcaggtgatgaagaaatcgatcgtacagaaagaaaaattgaagatttatgcttacgtcttttattacagcagcagccagtagcaagagatcttcgaaatatttctgcagcacttaagatggtaacagacatggagagaatcggagatcatgcaacagatatttccgaactggcgattgttctttcagagaaaacatacgttaaaaagttagaccacatcgaagagatggcaagggagacaatggtcatgcttatccagagcctggaggcttatgtagaaaaagatttggataaggcacagaaagtcattgcacacgatgatgtgattgatgatcttttcgaggaagtaaaacaggaattgattgaacttatcagaaatcatgctgatgaaggggaacaggcagtagaccttctgatggttacaaaatattttgaaagaatcggggaccatgcgacaaatatcgcagaatgggttatcttttccattacaggacagattgcgggctaaggaaaagattagcataaataaatatgaaaaagcaacgatacgaaaacagatttcgtgacatggagtcatcgttgctcttttttttgtatatttagaaatatttgatagtgcatgtcgaaaaaagaaataattttacataaactttacatagtactctcttcggattttacataggtatgttaacgtaaaaactagatattagaaaggtaaattttattttgctaacgtaaaaatgaggtgtgaaaaaagtaaaatctctttctagtatgaaactgacccgcgaatccgataggtggttcgtggttatactatagcaattctgtaaaataatacaaaagaattgtgcggcaaaaatgagaattgctctacatatgtaaaatataaaatggaggagagagtatggatatttttggtattttatcaatgataggaggattggcgttattcctttatggtatggaggcgatgggcgcagggctttcgaagctgtccggcggccgtatggaacgtcttcttgaaaaactgacttcaaaacgaattatggcggtattattaggagctggtgttacggcagtaatccagtcttcctctgcaacaacagtaatggttgttggttttgtaaactcagggattatgaagctgaatcaggctgtcggcattattatgggtgcgaatattggtacaaccatcacatcctggctgttaagtcttaccgggattcagggaagcagctttatattaaaaatgttaaagccatcttcattttcccctattcttgctatagtaggcataatatttattatgtttacaaaagatgagaaaaagaaagatattggtggtatttttctgggatttgcgattctgatgtacggaatggaagcgatgagtggtgcggtagcgcctcttgcagataatgagaagtttacaggaattctcacgatgttttctaacccaattcttggattgttagcaggtacgattcttaccgcagtaattcagagttcctctgcatctgtcggtattttacaggcactttgtgcgactggagcggttaatttcagtacagcattaccgatcattatgggacagaacatcggtacttgtgtaacagcaatcatttccagtatcggaacaagcaaaaatgcaaaaagagcagcagcagtacaccttttcttcaatattagtggtacggttattttcatggtcgtattctatacattgaatacgtttgttcatttttcatttttaaatacagcagcaagtccggcaggcatcgctgttatccacagtttgtttaatattggcgcaacgatcctgttattcccatttgcaaatcttcttgagaaaatggcaattcttgcaattccagataaaggatctgaagtagaagagatggaagaagagaaaatcaatccagatcttgcaagattagacgagcgtttcttagacaagccaggttttgcgatggaagaatgtcgtggcgtagccatcaatatggcaagaaagtccaaaaaggcaatgaatcttgcgattgatctgttaaaagaatacgatgaaaaaacatctgcgagagtagagaagttagaaaatcagattgaccagtatgaagatgccctcggtacttatcttgttaaactgagtgaacgagacctctctgtaaaggacagtcgtattttatcggtacttcttcattgtatcggtgactttgagcgtatttctgatcatgcggtaaacattcgtgatgccgctgtggaaatgaacaaaaagaatctgcagttctcagacaaggcaaagcaggaacttcttgtattttccaatgcgattcgtgacattatcgacagggcggtacttgcctttgagacaggagatactggccttgccaaagaagtagaaccgttagagcaggttgtagatgcactgaacaaagaggaaaagcagagacatattaaccgtcttagaacaggaacgtgtaccatcgaacttggatttgttctttcagacatttccacaaactttgagcgtgccgcagaccactgttccaacatcgcagtatgtctgttacaagttgatgagggagggtttgacacccatgaatatcttgatatactaaaagaagaaaacagtgaagaatttcgacatgaatatatggagcttagtgagaaatacactttgccggagagtaaacatggaggaaaataattatggcaaatatttatatagtggaggacgacacaaatattcaggagattgaggcaatcgcattaaagaacagcgggcatagcgtagaacagtttgacgatgcggcacatttctacaaaaagttagaagaaaaactgccagaccttgcgattcttgacctcatgcttccagatgaagatggttatgaaattgtgaagaagcttcgccagaatcctgccacaaagaagctgccggttatcatggtaactgcaaaaacttccgagattgacatggtaaggggactcgatatcggagcggacgattatattaagaaaccattttccattatcgaatttattacaagagtaaaagcgattctgcgccgtactttagagcagccggacgataaatatatgacaatcggagacattttcttagataatgagcgtcatgtcgtttatgttgataataagggaattgagctgacttacaaggaatacgaacttttaaaacttcttatgcacaacgctggaattgttcttaccagagaaaaaatcatggagcgtgtgtgggatactgaatttgaaggcgaatcccgaaccgttgatatgcatatcaagacactccgtaagaagctgggagacagcagcagacatattaagacggtgcgaaatgttgggtatgttatggaataggggacttttttatgagaagaaagattaatgtgcaattaatcagtatctcgattattgcgattatttctacgatgctggtcatgctatttgtattttatgatttatttcaaacacaggtacaggatgatcttagcgccaatgctattgtattaaaaaatacaggaatttttcattcagggaacgaaaaggcaatacatatggattaccgggaactgcgtgtgacgtggatttcatcagatggaacggttctttatgataacgatgccgatgtcggaactatggataaccatatgagtcgtccagaagtaaagaatgcatttaaaagaggagatggaagtgctgttcgtcaatctgcaacaatgggaacgaatacattttattatgccataaaattaaatgatggctctgtcctccgagttgccagagaagcaagcaatatatggacagttggaggaaaaatttttccgattatagcggcgacgatacttgtgatgatgattctgtgcattatactggcacactttatgacaaagaatctggtaaagccgatcgagcagatggcagtggatattaatgatttttccattacaccggcatataaagaacttgctccatttgcagcaactattcgagcgcagcatgcggacattttaaaaagtgcgagaatgcgccaggactttaccgccaatgtttcgcatgaactaaaaacaccgcttaccgccatatccggctatgccgaacttatggaaaatggaatggtaccgccagaagaaatcggcagctttgcacagaaaatagagaaaaatgcccgacgcctgctttctctcattaatgatatcatccgtctttcggagcttgatagttccaatacacagcttcttgtagagaaatttgatcttttcgaagaagcacagatttgcgtagaaaatatgcaaatctatgccgagaaaaacgatgttaccataacttatgagggaggccatcaggaaatcaccgcaaatcgcgagatgattaacgaactgatcaataatctttgtgccaatgccattcgttacaataaaaagaacggaagcgtaaaggtcagagtggacagctcacaaggccacccatatatcagtgtggcagataccggaatcggaatttccaaagaacaccagaagcgagtgttcgagcgcttctaccgagtagacaaaagccgttccaaacagactgggggaacaggattgggtcttgctatcgtaaagcatatcgttgcgctgcacgatgcacagctaaacttagagagcgaagttggcaagggaacaacgattactgtgaccttctaaactgaccatagtaaactactaggaaaactcagaaaaacaaaatattaataccaaactgaccatattgactatatctaaattggatatttcaatatggtcatttttgctgtactatacggacagatgcaaaatttaacacagcaaaatttaacacagttaatacagacgctaatttatgaaaaggaatcaaaagctaattttattccgttacgctggacattccgttttgcccaataaaacaaaattcttctcgataagtccctcgaagaatttatggtcaaaactccatagcgtaaagttataaaattagcttttgattccttttcataaattagctgtgcgtagcagccagaagggattgaaatttttagttttgttaaaatttgctgtatttagcagccggaaataaagtataaaatttccgtctgtttcctctactataccttcaagctgaaaggagttttatcatgaataataatgcagaaaaacagtatgaattaaacaaggaacttgcccagatgttaaaaggcggcgtaatcatggacgttacgactccggagcaggcaaagattgctgaagaagctggagcttgtgccgttatggcattagagagaatcccagctgacattcgtgcagccggtggtgtttccagaatgagcgaccctaagatgattcgtggaatacaggaagcggtttctattccggttatggcaaaatgccgtatcggtcatttcgcagaagcacagattcttgaggcaattgagattgactacatcgatgagagtgaagtactttccccagcagacgatgtatatcatattgataaaaaacagttcaaagttccatttgtatgtggagcaaaagatttaggtgaggctcttagaagaatcaacgaaggtgcttctatgattcgtacaaaaggggaaccaggaacaggtgatgttgtacaggctgtacgtcatatgcgtatgatgaatcgtgaaatcgcacgtatcacatctatgagacaggatgagctttttgaagtagcaaaagaattaagagttccttatgaactggtattaaaagtacacgatacaggaagacttccagttgttaactttgcagccggcggtgttgcaactcctgccgatgcagccttaatgatgcagcttggtgcagaaggtgtattcgttggttctggtatctttaagtccggtaatccaaagaagagagctgatgctattgtaaaggcagttacaaactacaaagacgcaaagatgctcgcagaactttcctcagacttaggagaggctatggttggtatcaacgagagcgagattcagttattaatggcagagagaggaaaataaaatgaagattgcggtacttgcggtccagggggcctttatagaacatgaaaaagcattacagagacttggagcagagacagtagagcttagaaaggctgaagatttagagcaggattttgatggccttgttctgccgggcggcgaaagtaccgtacagagcagacttttaaaagaactctccatgttcgaacctttaaaggaaaaaatagaagaaggacttccagttttagcgacctgtgcgggattaatcttactggcacagaatgtctctaatgatgagaaacgtggttttgcgaccttacctgttactgtaaagagaaatgcttacggaagacagcttggaagtttctattacgaaggcgggattaaaggaatcggaacatatccgatggaatttattcgtgctccatatattgaatctgtcggggatgatgtggaaatacttgctgaagtagaggaaaaaattgtaggtgttgcctacaaaaatcagctggcattctcctttcatccggaattgactggaaatgataagattcatgagaaatttcttgaactaatcaaagtaagtaatgactaacttttgcactaaaatacgcttgtcagcgaaaaaagcctatgctacaatagatgaggaattgaataacagtgtataagttctgaaaggatgaaaagagaatccggttagagtccggagcgaatccgtcactgtaaggggagtctgtacaattatccactgaggcgatattgttttgggaagggtgtaccgacagagaactaagccaggagaactgcttatatacttagtcaactcatcttacggaattttaagagagctgtacatagaataaagagaatttttatacatactttggctggctggtggtaagattagtatatcagatgtgagatgacttccacatctgcaggtggcgagcaacaaatcagtatcagtggaggagtcaatcccccatctgatatagcctctagcaagaatgccggggcattcttgaaaaattcaggtagtatagtgaattagtacatcagatttagagtacgatagatgaaaagacttatagcaatataggtctttttttcgtatagtttataacttgtattattttagaagattaagtgggaatcctcagtaattcaattgctgaggaattcataatattatttttagaaggagagtatgcatgggatttcagttaggcaatctttatgtggaaaaaggacaaaaaacatgtggatttttgaagctgccttttacagaggatgagcttccggtaacattaatctatggaagggaagaaggaccgaccgtcttagtagatggcggtatccataatgcagaatatgtaggaattgagtgcgtcacaggtcttgcaaagcagcttcagccagaggatatcaagggaattcttatcatgatacatatcgtaaacgtgaatggatttcaggcaagaaccgtcagtgtctcggcagaagacggcaagaatttaaaccgtgtttttccaggaaatgaaaatggcacttataccgataagcttgcttactttatggaaaaagagattttttctaaggtagattattatattgatgttcataatggggactggtttgaagatctgactccgtttatttactgtgtgggaaatgcaccagcagaaacggtagcagaggcagagcgtatggcacaggcggcagatatgccattttatgtgaagtctcagagtggtaaaggcggggcttacaattatgccggctctctcggaattccatctgtattaatcgagcgaggctgtaatggtatgtggtcagaagaggaagtagcagcgtcacaaaaagatgtaaagaatattttgcgtcgtatcgatgtattaaaaacgaaaccaaccttatcggagatgcagatgcgtgtgccaagacatatgcaccatgcacattatattgattcagaaaaggcaggctgctggttcccgaaaaagaaagcgggacaggttgccagggcaggagaacttcttggagaattaaaggattactttggcaatgtcattgaagaaattcgtttaaaagaagatgcgattatcctgtatcagacaatttcatactctgttccggaaaattcaccgcttattgcctatggccattacgatacctgtattgatgatctcggtgatatgaatcatgaacatacccatgaggaactgcataagcatcataaagaacattacgatgaccatgccggaattcattcccgtgagatgtgggaggacatgatttgagaaatttaaaaaagaatacacatactttgacagaaggaagtatttggaagggcatcctgttatttgcccttcctcttttaggttccagtcttattcagcagctttacagtacggttgaccttatttttgtcggacagcttcttggaacaaaagcctctgcagcaatcggggcaagtggactgatcgttacctgcctgattggattcttcaatggaatggcagtcggaaccaatgtatttgcagccagacattacggagcaaaacgttttaacgaactgaaaaagttaatccagacaattttctggacaggaatcatcggcggtttattattgatggtgattggattgatattttctccaatctttttaacatggatgggaacgccgaaaagtatttttccgctggcggtacgttatctgcgaatctatatggtgagcatgatatccatagtcagctacaacctgttaagcggagtattgagagcgttaggtgactcgagaacaccgttactgtatcagttctttggtggaatcatcaatgtatttgctgactttatctttttagcagtgttccatatgggcgtggaaggaactgcactggcaacccttttttcccagacagttgcggcaatcggaattatgctacatttatatcggttaaaagaaccatatgccctgcgtttcagtataaaagaatgtagtctgcgtgagtttacggatatattaaaagtcggtgtacccgctggtgtacagtcgattatcattaccttatcaaacattatcatccagtcacagattaatacacttggcgttacagcggttgcatcttttacagtctacttccgtgtggaactcatcgtatatctgccgattatcgcactcggtcaggctgtcgtatcctttgtcgggcaaaattacggagccggaaactggaaccgaattaaaaaaggaaataaattcagcatccttggcggttcttttgcaacatttattgcctgtatactgcttattatcgcaatgccagttatcctaaaagcatttacaaaagatactgccgtagcagcacagacattagaaatcataaaagtaacctttccattctactttttctataccgtactggaatgtttcagcagtaatttaagaggatttggaaaggcgttcttaccgatggtcgtaacagtcgtaagtttctgtggattccgcattgctgcgctgtttgtacttatggcacagaatccttcctcggataaagtggcgctttcctatccgatatcttggggaattgcggcaatagcaatggcagtgctgtatgtgaggaataggagcggagagaaaactctgtagtttaataaagatagatgaaacagaggaaagcatagtatcgtagatgtaaagaaggagcggcaagaagtcatctataaaaagagcctccttataacgcttgattttgtgactttgtgttttttacaactgagcaaaatcaagcgttataaggaggctcttttgctaatagcgtaactttgctgctccgctattatatctgtgttttctattaagtacaataccgaaatgttttatctgtaaggattcttgcaaaaatcaacccaagtggtaaagcaagaatgattaaaagggcagaggcaaaccaagtggcggaggtggcgagggacataattcccaagttgtagaatccgcggtagaggtagaggcctggaaccataataacgatggaagggacggttacggaaattcttgggtagccgactctgtctttcatgagggaggcaaggattcctgcggttaaggctccgataaaagctgcggcagcagggggagcatttacaaggtcaacgagttctaatcgaagtgtatttgcgatagcgccaatacttgcggcggcgactgccagtgggattgggctgttaaacatgatggagaatccgaatacaccgcagaaacttgccagaaaccggaaaataatccaaccagctaaaggcagagaaatctttataaaatcaacaggctgtaaatgtaaaattaatgccataatccatgcagacattgttgcgactaaaatgatgattaatgcataaccgagccgttcgataccggaacgcatatcaagttttgcaaggtcaatgccgcttgtgataaatggaaatcctggaatgatgaacagcatcgcgcagatatatcctgcttcatgtttgacggaaagtcccagaaagatttcgcccaattttaaaagtccggcataggaaaggcaggcgagggaaacggataagacaattcccagaaacaaggtataatggtgcttggtaagtttacatcttaaaaagtttccgagaccagctccgacaaaagcacaaaacatttcaatcggtccgccgccaagcaaaaaggtaaatcctccgcaggcaagagcggcagcgataccaagggcaatcggtgaataaagtccatgaatctcttcaatattatcaagaagattatgtaactgctcaccggacatatcttttccttctgtttcaaaatcctgaataaaatgctccagacgattcagttttgaagtgtttacaccagtattggtcagacagagtgactgcgtaaagccgtcctgaccatcaaaacaggtatattcaatagacatcagaccgatatctgcggtacaggtcacgcccatcacttcagcgagagtattcatagaactgcgcacacgccacgcaccagttccgcaggataaaagcataatgccagcacggccgataattgaggctttttccgtaaggcttgcttgtacaatagggagattttgcccctctttatcggtatattcatgccagagcacatccatatgattttttcttatcatagtttcactcattttaacattccttcttactagtttatagaaacagctattgtttaatttttcctgtatttttatagaaatagctgatattctcacagttccagactttccattccagcctttttcatcattttttcacggcaggctaaaacaagcccatcgatttcgcttaaatgatgaagcattttcttttcaaattcccgaatagggagaagaataccaatctcgtcaaaggtctgttccttttttaatccggtttcctgaccataataaacgatggcatgaggtgcttctttttgaatattatggaacgtatcccacacaaccgcataagcctgtgcttcggtaagacctatctttttcgtatcgggaagtgcataaagaatcataatgccacgccgtttattttctcttttttccgtaatttccatatcagtgtcattaacataagaacggacaatgtcataaccatctgcgagatataattttgaacggggagcacaaatatgatttttatacgtttccttaaacttgctatactctctgccagaaactattttttgtgcttctggaagaagttcaccttctggatttgttaaaagtacagggttcttccctgcttttccgtgaaatcgtttcggaataagatacgcctctcttaaaaggtcaaacatactctttccacaaagctttaataaaagagcactgatatccccattttgataggcataaaataagactttagaaaaatgttttggattatccgcttctaataaatgattatcgtccattacatcatagaaaatatccattaattttttgcaggaatcaggggaagcaagaatctgtgaaaagatggcttcaacttcttcctctcttggtaaaacgctgttcataaatacaccggctttctatacttattcttggcttaagtataggaagctggtggattaacatcaaatgttttatttacataatagatatgtggatggtgtatcttgctaaaatgaaatatttttgtattggtggagaattatttttttccgcacaggcaggtgattacgtctgtgcagttaaagcagcgattgcaggagatacaggctgctttttcgtttgaggttctccatttgtttggcagatcggcttctcttactaatggtctgccaagagaaatggcggtaagagaggttgatgatagtatatgctctatgaaatctggggagcggtagcagccaacgctggatactgggatttccagagtatcagatacgaggagggcactttctaaaaatttgccctctcggtcgccgtttcttaaaacaggagagcaggaagcgccgctgttgtcagcactgattccagaagaaacttcaatgaaatcaattcctttcttttctagttctttacatacccacaacatttcttctggtgtactggaatcagagacaagatcactgaaagaaagttttaaggcaattggataatctacaccgacggcattacgaacggaatcgtaaatctcaaatagcaggcgggaacggttctcgatcgggccaccatattcatccgctcttttattaaaatgtggagaaagaaaggttgttaataaaaagccgtgtgcggcgtgaatctgcacaccgtcacatccggctaatttacatttgcgggcagccacaccaaaatcatgaacaacttttgctaattcgtctttggtagccgcatgataaataatgccatcagccactttaataggtgatgaggcaaaacggtcgtagccattcttccagtctgtgcgcgggccggcatgctgaagctgtacaaaaatacggctgctataccgatggacttttgacacaatacttctcatatcctcgagatagccatcatattccgtatgtatcattcctgggccgttaccggcagtcgaagaaatcgcttccataccagtgataatcagcccgcatcctccacgggcagcatcttcataaatctgcctgtgctggtctgtgatccttccctgattcgcgcagtattcaaacattgcactcttcacaatacggttcgaaatcacaatatttcctatacgatatggtgtatgcattaatttactcataaaagttcctcctccaaaacaattgccagagtattttcaaatgcactccagccagagtaattctttataaatatccgcaataaacaaatatttttaatgttatagttgatttataaaactacaaaaacactatcctaatatatagtttagcattttatcagtcatcatctatggagaaaaaaatacaaaatctggtataaaaaatatgcacaataatcttgaatacatatccataatgcgttataataaaaaatgtaaatacagaatcttcggggatgggtgtaattccctaccggcggtgattgttactgactatttagcaggcgggtgagttatagaactagagcaattttcaaatatgctctaggttatagaaactgcttacatagctatagataaatcagagcataagcccgcgagccattggcatgattcggtgcgaatccgaagccgacagtacagtctggatgagagaagaatgagaagaaagcggtttttgcagacgtattgttaggtatagatttctggatgccaggcagtatttgatgtaacagacagcctcaataaaagcgtaacttcgtcccgatatcttattatcggggcttttttatttgtaagagcgattcccgttcttagtaaaatgaagaaccctctgggaaatttcatttaagttaactaagcaggcttttaatcaacttccctattcacacttcataatttggagataatgtattttggatagatagagtgtatttgcaaatatttttacgaacacattctattattctgaattttttagaagacaggagaaattattatatcagatgtgagatgactccacctctgtaggtggcgagcaacaaatcagtatcagtgggagagttaatccccatctgatataatgatttctccgtctcctatcacttttaccaaaagaatggaggaaaacaaaatgaattattatcttggatttgatgcaggcacacagagcgtaaaggtcgcagtctatgatgaggatatgaattgcatcgtatcatcttccgcaccgacaacattaacctatccagaaccaggctgggtaagcatggacgttgacgaatatctcgccctcaccatcaaagggatgaaagaatgtgcatcccagatgaaagaaaaagggcttgatgtcacaaagattaagtccatcatgggcgatggtgtcatttgtggaatctgcggtgtagataaagatggtaatgcgattacaccatacattaactatctggactcccgtacaaaggaagatgtagaactcgtaaatagctgggagttggagattttcggaaaagagacaggtaacccggaggcaaactgtatgtttcctgcaatgtttgcccgctggttcctgaaaaatatagaaggctttaaagaaaatggtgcgaagtttatccacgatgctccatatgtattagcacatcttgccggactttctgcaaaagatatgtttgttgactggggaactatgtccgggtgggggcttggatataaagtagaagaaaaatgctggtcaaaagaacagcttgacattctcggtatcccagaagaaatgatgcctcgtatcgtaaaaccgtgggatattatcggacatttaacagaagaaattgcacaggaaaccggactcccggcaggaatcccaatctgtggcggagcaggagacacgatgcagtccatgattggaagcggcaatatggaaccaggacaggcagtagacgtagcgggaacctgttctatgttctgtgtatccacaaaaggaatcatcccagaactaagcaaaaaaggagccggacttgtatttaacagtgggtcccttccagacacttacttctactggggatatatccgtaccggcggacttgccctgcgctggtttaaagataatatctgtaaaaaagcagaagacggcagctactatcaggtattagaaaaagatgccaggaaagttccggcaggctctaatggtgtacttttcctcccgtatttaacaggtggaatcaacgatattccagatgccgtaggctgtttcttaaacatgacaatggataccgatcaggcaaccttatggcacgctgtattagaagccatcggttatgattacatggaaattacagacttataccgctccgcaggcattgacttaagccggatcaccatcacggaaggcggaagccgtgataatatgtggaatcagatgaaagccgatatgttagacagccgcacagtaacactggagaatgcagcaggagcggttatgacaaactgtatgtttggggcatatgccgttggcgatgtggataatattgcagaggcattaactgggaatattcatttgaagaatgaatttgaaccgaatgaggagaatgtgacattttatcgcggacagtatgagaagaaaacacatctggtgaaggatacaatgaaagaggcatttagcatcttggcagaattaagataaagtaacaatcagccgcacctaaagagagaagctccctatatctgtgactctatcactgtgggttggatgcgagcgcataagcgagcattcaacctgccgctatgaaagaaacaaataggaagcaggggcttctttagtttcgtctgtcatccgattgaattatttttccaccatccgcccttgataaatagcaaaacttttgatataataatcgctgacctttggagatgtacccaagtggctgaagggtccgcactcgaaatgcggtaggtcggctataaccggcgcgagggttcaaatccctccatctccgttaagatattagagcattcttcgaacatgctctgcaaatatgaattacaagagcggcaaggctttaaagataagtcatgtcgcttttcttcttattgaaacgaggtgaaatagtggaaaatatcgtaatgggaattctggcacatgtagatgcaggaaagacaactttatcggaaggaatgctctatctgtcaggaacggtgcgtaagcttggacgcgtagatcacaaggatgcatttcttgacacttattctttagagcgagacagaggaatcaccatcttttcgaagcaggcagttttttcattgggaaatagacgaatcaatcttttagatacgccgggacatgttgatttttctgccgagatggagagaacactacaggtacttgattatgcggtacttgttatcagtggagcagatggtgtacagggacatacggaaacgctgtggaagcttttaaaactttatgagattcctacatttatttttatcaataagatggatcagccaggaacagacagggaaagtctgcttacggaattaaaggaacgtctggacgaaggatgtattgttttcggtaagggaaaaaatgtagaatccctagaagaaatagcaatgacagatgaagtagtgcttgattattttatggagcatgaaaccgtaagaaatgaggacatttgccgtcttataagggaacgcaagatttttccatgctattttggctccgcattaaagcttgacggcgtacaggaattacttgcaggatttgaagagtacatgaagccatttgatgggaaaaaaggatttggtgcgcgggtatttaagatttcgagggatgataaaggagagcgtctgacatttttaaaggtgacaggcggtaagcttgttgtaaaaatgccgataaataaagaggaaaaaatcaatcagattcgtatttactctggtgcaaaatatgaggcagtaaatgaagtcgaagcgggaggggtctgtgcggtgacggggctttcttcttcctatatcggtcaggggcttggtgtggaaaaaggaacagcagctccatttttagagccggttctcacttatcagatgattctgccggagggagcggatacgacaaaggttcttagggagttgaagcaattagaggaagaagaaccgctgctcaatattgtctggaatccggcactggaagaaattcatgtgcagcttatgggagaggtgcagacggaaattttgaaaacaatgattgccgaacgttttcatcttgatgtggaatttggcacaggtaaaattgtatacaaagaaacgattaaaagtccggttgtgggagtgggacattatgagccacttcgtcattatgcggaagtacatcttaaaatggagccgttagaggcaggaagtggtcttgtttttgatacggattgcagcgaggatgtattggatagaaactggcagagactaattctcacccatttgcaggaaagagagcatccgggtgttcttacgggggctccgattacagatatgaagataacgattgtggcaggaagagcgcatttgaagcatacagagggcggagattttagacaggcaacataccgggcagttcgtcaaggattaaaatcagcggaaagtgtgctgttagagccgtggtattcgtttgtgttagaagttccatcggaacaggtcggcagggcaatgtctgatatcgggcagatgaacggaagttttgaaggaccggaagcagaagataaacagggcatggtacgtcttaccggaacagctccggcatcagaaatgcgggattaccagcgggaagtctgggcatatacgaaaggccgtggacgaattaccctcacattaaaaggttatgagccttgccataatgcggaagaagttatcgaagaaattggatatgacagtgagagagatgtggataatcctaccggttctgtattttgcgcacatggtgcgggtttccttgtcaaatgggatgaagttccggaatatatgcatatcaaggaggactttttggcagaaaaaccgggtatagaacaagatgaggtgatggcagtacagatggggaatcattgtaattattctggcggttattcctccagctacgatgatgacccagaacttctcaccataatggaacgagaatttggctcaaagcaaaaagaaagagaccgctatagcagttaccgcaaacagactgtttcaacaccagtccgccacacaactgtaataaaagaaaacgaaccgaaaaaggaatatttactagtagacgggtacaatattatttttgcatgggaagaattgaacgagctggcaaaggcaagtatagatgcagcgagaaataaactgatggacattttaagtaattatcagggctttattggctgtacattaatccttgtttttgatgcgtataaggtcaaaggcaatcagggagaagtgcagaagtatcacaatatttatgtcgtgtataccaaagaggcggagactgcagaccagtatattgaaaagacgactcacgaaatcggccgaaagtataaggtgacggtagcgacttccgatgccttagagcaggtcattgttatgggacagggagcttatcgaatctctgcgagagatttctatgaggaagtagagcggacagaaaaacagattcgggaaatcaacgagagggaacgaggagaaaaaagaaattatcttttagattatgccaaggaagaagatgccagagagatggagaaagtccgacttggaaagacaacagagaaatagttgaaaaacgagcataattcctaccgaaatggtatagtatgtgcaaaaaaacaatagaaaaagccctcatatttgttgactttttaaagtccctatgatatatatgggatttaggcgttacataagaatttagaggaggatactatgctcgaattacaaaatatcagctatttagttgatgacgataataaagaaattttaagagatattaatcttgcatttgatgagaagtttgttgcgattaccggaccgaatggaagtggaaagtccaccctggctaagattattgctggaattttaaagccaacctccggtaagattttattagatggagaagatattacagatttaagcattacagagagagcaaataaaggtatcagttatgcctttcagcagcctgtaaagtttaagggattaaaggtaaaggatttaatgagcgttgcttcaggaaagaccttagatattaagggaatctgcgatattctttcagaagtaggcttatgtgcgagagactacattaacagagaattaaatggcagtctttccggtggagagcttaagcgtattgagattgcgatgattaaggcgagagcgacaaagctttctgtatttgacgagccagaggcaggaattgacctgtggagttttaacagtctgattcatgtatttgaggaccttcatgaaaagacagacggtacgattctgattatttcccatcaggagagaatccttgagattgcagacagaatcattgtaattaatgatggacttgtggaaaagagtggaaagggagaagatgttattcctgaactcctttataaatcaagtatgtgccagaagttaagcagagattagggaggaaaaatcatggatttaatacagaaagaattgttagaagagattgccggacttcatgaagtgccagcaggtgcctataatattcgtgcgaatggaaaggcagccgcaagaaatacaactgctaatattgatattgtttctaaagaagataagccgggaattgatattatcatcaaaccgggaacaaaaaaagaaagtgtgcacattcccgttgtaatcagtcagactggattaaatgaccttgtttataatgattttcatattggtgaggattgtgatgtaacaatcgtagcaggctgcggtattcataacagcggtgacgggctttctcagcatgacggtattcatgaattttttgttggaaagaattcaaaaatccgttacattgagaagcattacggacagggtgacggcaagggcggaaaggtaatgaatcctaaaaccattatccatcttgatgaaaatgcttatttttacatggatacggtacagattaaaggtattgacagtaccatgcgtgagacagatgctgacttaaaggctggggcaaagcttgaaatctccgagaaacttatgacacatggcgaacagacagcgcagacacagttttccgttgatttaaatggagagggaagtagtgcgaacgttgtatcccgttctgttgcccgcgatgattctgcacagttattccgcgcaaaaatcgcaggaaataatgcctgtgccggtcatagtgagtgtgatgcgattattatggataatgcaaaagtccgtgcaattccggagttagaggcaaatgaccttgatgcagagctgattcatgaagcagctatcggaaagattgcaggcgagcagcttatcaagcttatgacacttggtcttagtgaagaagaagcggaggaaatgattatttccggattcctgaaatagggaaaattttattttcaggttcttaaaatcgtgttataatatgttccgcaactattttgcaggacaaatgtagtttgcaagttatagaggaatcgtttagaatataaagaataacagcgaataagaataatagggggcttcttttatgagacaatgtatggatatggataacttacacaacagattaaaaagagtagatggacagattaaagcgattgaccgtatgattgagcaggatgttccctgtgaagacattattattcagattaatgctgccaagactgccttacataaaattggccaggttgtgttagaaggacatctgaatcactgtgtgaaggatggaattgaacacggagatgcagagaagacaatcgctgattttgcaaaggcgctagaatatttttcaagactgtaatcgttaaatgtttttccagtatagtaatcgtatgtgagcgtaaatgcatttccccgataaaataaaataaaataaagaagaggacataggattttttagaattttatgtccttttttgctatgaaaagtgcaaaacaaaatagatagaagatggataattttattgctacagaaataaaatccaattataatatatatcaaggggaggtacagccgaaccatatgagaaaatgtgaggtatatatatgagcagaacagacgaagaaatcaagagatttgagacaaagatgaagtcttgcacaacgatgacagacttgcttgtagctatgtcatcctggcagagttatgcacagagtcataatcttgagccagaacaaaaaaggacagtagatgaggcgtacttaaaagcagaggaagggctgattactgctgtaaaaccaagtttatggtaataaatttaacagacggctagtggagggagacaaaatgaacggaacgaaagggaaaatggcggaggcatttaaagagcttgtatgtaagaagtcttttcagaagattacaataagcgacatcgcaaaagagagcgccatgaccagagagaatttttattaccatttccgggataaatatgatattatgcactggatttttgaacagcaggtggccgcacagcttccagaggatgaggagccatttgaaatgtggtttaatgccttgttttgtaatacctgtgaagattacaaatattacaggaagctgataaaaagtcttagtgcggaggagatacggtcagatttatatcctttatttgaaaggagggtacggctgttagttcaagattgtcttgacgattctgtatggaatctcaggaaagagaaagaggatttcagtacagcatttttcacggatgcttttcttggattttatataaattacataagagatcatgaggaaatagactataatatgcttcagattggtctggaatttctctttgataaatttctttcaaccgtaagaattacgaaagaggaatctagcgagcaaaaataataaaaattagataaactatataaattaaatataggaatgattactataatagtgcaaaataacccatgaaaatggaattgtatggtaaaaaaatgaaaaaatatcgtaagaaatatgacagattctcacacaattcttacaatgtaaaaagacaaatacccctataagtgttatatttaaatcagcactagtgtacttaattggaaacattaattgaataggaggaattaataatgactaacgtaattattggtgaatttgtcggaaccattttacttgtattattaggtgatggtgtttgtgccaacgttacactgaacaattctggatttaaggcagcaggtcctttatttatagctattggctggggtcttgcagtagcacttccagcagcagcattcagtggaatttgtccagcatcttataaccctgcacttacaatcgctctgttcgcagacggaacattagcagcagcagatggctacacaatcgcagttattatcgaaatgattatcgctgagatggctggtggtttcattggtgcagtattagtatgggtagcatttaaacctcagtttgatgcatcttcagatttaggtgatagccttagaggtgtattttgtacagctcctggcgtaagaaatctcccttacaacattcttcaggaagcaatcgcaacattctggttagtattcgctattaaagcagcttgtggcgcatttgatcttggaacatttggtgtattcttaacaatcgtttcttgtggtactacatttggtggtcttacaggatacgctatgaacgcagccagagatacagctcctcgtttagcatttgctatcttacctattaaaggtaaaggagatgctgactgggcttatggtttaacagctccattaatcggacctgtaatcggtgcattagtagctgtagctgtttacgctgcattaccattatagaatataatagtaatctaatttgctacataatataacaaattaagagactatcgtttttacgatagtctcttttattttactcaacaaacggacgtcaactgaaagtgtctaagattaaatcctcaaacctttcctcaactgtttttgactattatttgtaaacatcttttgataatttctgactaggcagaagttcaggagcatcagcctcttgatgaataaaaagtgattattttaagccagatacttagccagaaataccgctaccacaaaaataaccgtcaaaaacaacatcgtattcattggaatattcacacggggaagtcctccctggtcagggcggatttcgaatttgtttctattttcccaggcatcttgcaaacgttcttctctcgtttgggtcttccagcgttccatattttcttttcctaactcttcaaagagagcagagtcacttttaagcccaagagcaactctgtcacgaggagataaggtttcatcttttcgaatatcatatccacaatcaggacatattttttcattaaatgggtaaacttttccgcacttgcggcatttaatcgtagtcataaaaataccaccccttcttttacattattagaattataacacgcttattataacttgacaagaacacagagaatagcttatcatataaagataaagtggctgtgacatcttagagcgtgtatgaaaaaacattctagtttaaacagtcagaatcaggaggaagaacaatgacagttgagatgtggatggggcttggaattgttgtcgcaattatcggctttattatgtggcgtgcaggattaagtatgcaggcaaaaagaaaccgaaacgcaggtatggttactatgatagcgtggttacttctcatggttggagtaatgaccgcattttcatttttcagagtaaagtatttaagctgatatttaagttccaacgtaaataatttaatagtgaaaatttaataataatgagagaggagagcgttatgagaatttctacgaaaggtagatacgctcttcgtttaatgcttgatattgctatgaatgatgcagaaggaaaaccggtgagagtgaaggatattgccaaacggcaggaagtgtctgggaagtatctggaacagattgtttcggtgctgaccaaggcaggatatttaagaagtattcgtggcccccagggtggatatcttctcacaaagcgtccggatgagtatacggtaggcatgattcttagaatcacagaggggagtatggagccggttccttgtctggaagagggaagcgaagtttgcgagagaatggaagaatgcataacgattcctctctggagaaaactgagcgaggcaatcagcggagtgcttgatcatacgacattagatgatttgattgaatggcattatgcgaagaatggtaatgattatgtaatttaaaaaggcttctgaaattgtaggagaatatgatttcagaagctatttttctattgggtggcatatttatagagaaaggagagaaggaatgataggacagtatacattgcagcagtggattttatatttttatgtatattgctttttaggatggattttcgaatcttgttatgtttcttttaggaaaaaagaatgggtaaacagaggcttccttcatggcccttttctccctatttatggcagtggggcagtcatgatgctttttgtatcagagccgtttaaaaataatctgattttgacatattttgccggagtagtaggagcgacattgctggagcttgtgacaggggcggcgatggaggcattattaaaggtgcggtactgggattattcaaatcagaagtttaattataaaggatatatctgtctgtcctcttcggttgcctggggatttttgacgatattgatgaacgaagtattacatccggcaatcttacacgtgcttgctgttataccaaagatggcagatggagtctttgtgtggatagtaagtgcaggccttgcagtcgatctgtgcatttctgtacgtgatgcgattaatcttagaaatattcttgtcggaatggaaaatgtacgaagagaagtggttatacttagaaagcgggcagacatagttattgcagttcttgatcaggagtggagagagtatgtaaagaatcatccggcagcagagcgtatggatgaaatcagtaaagaaatcgagatgcgtcttgctaagatgaaagaaatggcagaacttccgaagcttcctgaacctcagaagttagaaatgcttgaagtaaaagaaaaaatcggtaagttaaaagaacgaggcttcatactgaaaagaaaaggaacaggcagcgtcagaacgcttattaaaggtaatccaacgatggtatctccaaaatatgcagagtcttttaaacagttaaagggatatttgaaagagtttgaagaaaaaagaaaaggaaaagactgacaatttttttaagatattgtgaagtccttggaaaatgcattgacttattaaaaaagatgcgttacattttttaaatgataaaaagtgctgaacaagacagcggtctgtatacttttgctatgcttggctttggtgtatatcgttttcattcgtttgacacagctatgcgttttttattcgaacgaaagagtctgcgattgtgacgcacatcttgcagaaagcatttttcaaacacgctctagaatagtgattgggtaaagaaaaaggtgatgttatggcagaaagattaaaaaaatatagacatggattgctccttttgtactttccattttatttagcagcatttgcatatttagagaagaaagtaccggataaagtacatattatcaattgtgcgattgatcagtatattccttttgtggaagtatttatcataccgtatctcttgtggtttgcctacgttgcggttgcaggcatctactttttctttaaggaaaaggaatctttttgtaagtggatgtattttggaatgattggaatgacaatatttattattgtgtcctacttatatccgaatggacttgaattaaggccggagacatttaccagagataatattttcgtacaattaacgaagatgatttattccatggataccccgacaaatgtgcttccaagcattcatgtatttaattcgatggcagtatattttgcagtaaagaacagcccaaagcttaaaaataataaagcggcgagaacaggagcctttgttatgacatcgttaattatcctttcaacaatgtttttaaaacagcattctgtagtggatgttcttactgcactgatactatcttgtttaagttatgactttatttacaatgaaagaacagaaaagattcgggacggtttagaagaactaaaatttcgcagaaaacgcaaagaattttccaaatattaaccttttcctgcatagttcaatgtgatagaatacatataacagagaacaaagcagacgaggaagtgtaaaaatgcgaaagataatatttatcggaagaagtgaagctggcaagacaaccctgacacaggcaatgaaggggaagaagattgtctaccataaaacacaatatatcaatcattatgatgtcattattgatacgccaggtgaatatgcagagacgaaggaattagcgggttctctggcagtatatagtgcagaggcagatgtagtaggacttttgattagtgcaacagaaccattttctctgtatccgcctaatgtaacagcccaggccaatcgagaagtagtaggtattgttacaaagtgtgaccattgggcaggtaatccagaacaggcagcagaatggttaagactcgctggctgtaagaagatatttatgacaagttcttttactggagagggaatcgcagatatcatttcttatctgaaagaagaacatgaaacacttccgtgggaagaggtaaaagcacagtatgataatcttggctacggtgagggagaatctgataaaaaaatgaatatcaatggggtgttgatataatttttgcgccgaccgaaacggagtgcagaattgcagagatgtgcagaagaagtatgtcatgcattgcatgacgcgcatctcgcagcaagaatgcccggtattcttgaacttaatagatttttttaatagtaaaagcaaaagagaatgctcctacaagtgattgcaggagcattctcttttgcttttactatttattttacatatcttatagtttggatatattttaaccaaagtatctcttaagtaatccttcgaatgcttttccgtgtcgagcctcatctcgagccatctcatgaactgtatcatggattgcatcaaggtctaaagctttagcacgtttagcaaggtcaaacttaccagcagtagcaccgttctcagcttctacgcgaactctgaggttctcttctgtgcttgcggaaactacttcaccaagtaattcagcaaatttagctgcatgttctgcctcttcataagcagctttctcccagtataaaccgatttcaggataaccttcacgatgagcaacacgagccatagcaaggtacataccaacttcactacattctccttcaaagtttgctcttaagtcagccttgatatcttctggaacatcacttgcaacacctacaacgtgctcagcagcccatgtcttttcctcagactgttcaataaacttagaagcaggtgccttacaaagtgggcagaattctggagcagcttcaccttcataaacatatccacatacactacatacaaactttttcataataaataatctccttttctaaaataaatgtctgataacttttaagatggcgtcttagcggttatcgaaagcatataagtaacattgcatagtaatgaatacttcttataaaatttatttgcaagaagtaatgataatcattactgttttataataacctaagaaacgaagtttgtcaacaactaaatgaaattttttttcaagttcttttattcatgcagcttcggtaaatcagaaattttttgttgctttttttgtaagagtatagtaaaataattaagtcagtttttgacaagcttccttggctcagttggtagagcaacgcattcgtaatgcgtaggtcgccggttcaagtccggcagggagcttttttatttttataaacaaaaatcgctgcacgtagctttcgcaagccatcgcgcagcaattttgtttaatcagaattcttagcacatttagcacaataacctcggaaggttattgtataatcagagataattccatcaaatcccgctccgatttcttcctgtggatgaatcgatggtttaaaaggaatatcctgcaggcagccgcaggacttacattcaaaatgagcatgaggttttgtctgtccgtcaaaacggtcagcgtggttctcacaggtaatcttcataatttttccaagagaagttaatagtgaaagattacgatatactgttcccaggctaatattaggaaagctttcccgcagctcctgataaataatgtcggcggtaggatggtcatgatgacgcatcacacattctaatatggcgtttcgctggcggctgttcttcattggcgcacccattggcaaatcccctttcataattaaaatattaataaataaaataataaatataaaacatgcaataacgataaaagttactattttcataataaaagaaaatagcaatgctgtcaagagttattaagaaaataagattttcaataaggaaaaaatattgacaaagaaatgtgggaatagtatgatactagagtcaaagggtcacattttcatgattagatagaatacaagaagagagtcttgccaaaacagcaggaagtattgtattcgtgatagttatgtaaagtgtcaagacctcggatttttattttacattaattttgaacatgaataacacattttataaaaaggagattttttcttatgttagaaaagatgaaagagattattgcagaacagttaggcgttgaagaggatgagattacaccggatacttcttttaaggaagatttaggagcggattctcttgatttatttgagctgactatggcgttagaagaagagtacgatacagagattcctgcagaagaacttgaagatatcgaaacagttggagatgttattgagtatttaagagaaaaaggaattgacgaataggcagtagataacaaaagaactgaccctgataagtaagattctgatgaataggtattgaggaatggcagagtcctcagtaccttttttcacgtcagaatagtcgtaaatcttacgaaagtgcgtcattctcaggttagttataaaaaactattggaaatttgagaggtttcgtttataatggtaacgagtgtgtcagtatttgacatagagatacgattttgatattgattttcaattaaagttggaatcaatatttgggataaaagttgtggagtttgtaaggaaaggagattcctaatggctacggatattggaattgatttaggtactgcgagtattttggtatatgtaaagggtaagggggtcgtgttaaaagagccttcagtagttgcttttgatgtcgatacaagaaagattaaggcaatcggtgaggaagcgcgtctgatgattggacgtacacctggtaatattgtagcggttcgtcctttaagacagggtgtaatcagtgattattctgttacagagaagatgctgaagtattttgttcacaagtcagtgggcaagagtttatttggaagaaagccaagaatttctgtctgtgttccaagtggagtaacagaagttgagaagaaggctgtagaagatgctacttacgcggcaggagcaagagatgtaaagattatcgaggaaccggtagcagcagcgatcggtgctggtattgatattgcaaaaccatgtggtaacatgattgttgatatcggtggcggtacttctgatattgcggttatttctctgggaggtacagtagtaagcacatctattaaggttgctggagatgactttgatgaagcgattgttcgttatatgagaaagaaacataatctgttaattggtgaccgtacagcagaagatatcaaaattcaggtgggaagtgcatacactcgtgcagaagagtcttctattgaagtaagaggacgtaacttagtaaccggccttcctaagacagttacggtaacttctgaagagacaagagaggctcttcgtgaagcgacagcacagattgtagaggcagttcacagtgtattagagagaactccgccagaattagcagcagatatttctgatagaggaattgtacttaccggtggtggaagtatgttacagggattagagcagttaattgaggaaaagacaggaattacaacaatgacagccgatgacccaatgacagcagttgcgattggtacaggccagtacattgagtatcttggtacaaagtaggagattttaaatggctcatctggaaggatatgttagtcatattcgctttcataatgaggaaaatggatataccgtaatggaaattgaaacgacccacggggacgaagtcctcgtgggaaattttcattatatcaacgaaggcgagtatatttgtgcggaaggcgaatatgtagatcatccggcccatggtccgcagtatcggatgacatcttatactgtaaaggagccggaagataaagcggcaatggaacgctatcttgcatctggtgctattaagggaatgggcccggcattggcggcaagagtaatcaaaaagtttaaaggtaatacctttgacattatagagagtgagccggaacgtctggcagaagtgaaggggatttctctgaaaaaagcgatggatattgcggtacagtttcaggaaaaacaggagatgcgccatgcgatgatgttcctgtcagagtatgggattaccagccgctttgctgtccgtatttttgaagaatacgggaataaaatgtatgatattttgaagacgaatccatataagctggcagaagatattacaggaatcggatttcgtgcggcggatgcaatcgcggcaaaggcaggaattgcccctgattctgattttcgtgtctgtgcggcaattttgtattctttgcaacaggcggcactttccggtcatgtttatctgccaaaggatgtattatgccggagcgcgggacagcttctttcaatggctccagagtttatagaggatcatttgatggaattggttcttgataaaaagctgatgattcgtacaataggggaggaagaacatgtgtatttaagttcctattattttatggaattgaatacatcccgtatgcttctgaatcttgacttacatttcccgatggaaaaagggaaatatggacgacgaatcagcgaattagaggaatcaatggattttcagcttgatttgttacaaaaacaggctgtggaagaggcccttaccaaaggtgtagtagttgttaccggcggtcctggtacaggaaagacaacaaccattaatcttatgatacgctgctttgagatggagaagatggatattgttctggcggcccctacaggaagggcagcaaagcggatgacggaagcgaccggctatgaagcgaaaacgatccatcgtcttttagaagtatctggtggtattgaagatggggacagttctcattttgaaaagaatgaggataatccgatagaagccgatgcggtcattcttgatgagatgtctatggtagatattcatctgatgtattcacttttgaaggctattgttccaggaacaagactcattcttgtaggtgattccaatcagcttcctagtgttggtccgggaaatgtgttaaaagatatcattgattctaaggcattcagtgtagttcgtctttctaaaatatatcgtcaggcagagagcagccatatcgttcttaatgcacataaaattaatgcaggcgagcttataacactggacaacaaaaataaagacttctttttctttgagaagaaagatgtccgctcggtaatgggggcattggtataccttgtgaaaacaagacttccagagtatattggggcatctccatttgaaatacaggtacttactccgatgcgaaagggagaacttggagtagaacatttaaatgaagttcttcaatactatttaaatcctgcttctgaatctaaaaaagaaaaagaaggtcgtaccggtgttttccgtgaaggcgataaagtaatgcaggtaaagaacaattacaagcttgaatggaaaatcacaaacgcaaagggcttctccatcgaagagggactgggtgttttcaatggagatatgggtatcattaagcagattaatacatattctgaacgcattacggttgtttttgatgagaatagagaggcagaatacccattctcaagtttagatgaattagaacttgcctatgcgattacaattcataaatcgcagggaagcgagtatcccgctgtggttcttccacttcttagcggtccgccgattctgtgtaacaggaatctgctctatactgcaattacaagagcgcagaaatgtgttgcgattgcaggcaggcagtctatggtagagcagatgattcataatgagacggagcagaagcggtattcaggtttgaatgattgtcttaaagagggcctgtaacttaaagaaatatcataattgtgctggctctgggcattctaatgagttaatctctggcaattccaatgcagatagataaaatataaacttcagaaataccggcttctaaaaggatgcgggtgcaggcttccattgttgctccgctggtataaatatcatcaacaagtaatacagaaaagggagtactttgagagagaagtttatcataatgtgaattaaagcagaatgctttctttagattattgagacgagcctgtggattgaactgtttttgtggaagtgtatttacagagcgaatcagcatgtcaggataatgagggaggttaagagtcagagccagcctgctgctgagcagagcggcctgattataacctctctttttatatttatttttgtgaataggaacagggataaccgcatcagcacctaaatctcttagttgtgaaagtcggtacctgcaaagttcctgacagaaaaagtctgcaagtccccgcctgttctgatacttaaaagcactcatgataggacgagtcttcttattataaagaaaaagagaaagtcctctttgaaaactctttgggaaggcacggcagtcatagcagtattcttgtgtgtgggaggatacaggctttccgcagcgcatacatacaggggagtgtatcagagggagttctctgtggcattcctcatggataaaacttccgtaaggaagaagtttgtcgcaaagcgggcagtgcctcggaaaaagaaagggaagaagctgcctgattatccataaaatagcctgttcctgtgtattatgaagtgtagtgagaaacttttttatctttggtgagaaatcaaaacgaaaaaatagtttcttcatgagtgatcctttcattttagataaatataagaaaagtgctgctatctttcaataatgagagggaaaattttaagtttaataaataatcaatgattttaaagaattgttaagctctgccggtacttccaaaaccgccgcggtctgtaccgtttaaagtattacattcttcaaatgagataactggctggtgttccataatacggaactggcatatacggtcattcacatgaatctctgtatcacgaatagctaaaacaggcataaaccactggtcattatctccacaataagactcatcaataacacccatatgatttgtctgtataactccaaaattcttaaaagtagagcttcttggcacaacatgagcttcatagccctgtggaagttccatagcaatccctaaaggaataagagcaaattcgcctttctttaaagaaacatcttcagcagcgcgaaggtcaatccaatcggacttgccatcaatataggtgagtttctcaatcttgtctgtaaaatatttaatacgaattgtctgtttcataaatgaatccttctttctttataatgattactactaagatagtagttataatatctgtaagttttggggcttaacaacatcatgcacgaacgcttgtttttttgatttcttttttaaagatttttaatacatcggccgtttaacaacatcatacacgaacattcgtttcttgtcaataacaaaatttccataaattggttgaaaaataagcgggaaattgtctgaaaatagaataaaaaagaatctgttaatagatttgtttatatcttaaaggttgtcaagattttgtccacattttgagcgggaaaagtaaaatggcaaaaatagcatgaatatttgcttttctggtatgaagatgagttttatccactttatccacaacaaggtgtggattttgtggataacttatgcacattgcagaaaatataaaaaagttataaatgttctgagcatattgagcagatatggaaaagactttttcgggattttatgcagaaaaaggattgacgaagttaaatcggtatgatatattaatgtggcgatggaataggtcttttttttatgcctaaaatcggtttatgagaataaaccctacgtttaacaaaattggaggtggaagttgtgcgcgtgagaatcacattggcatgtacagaatgtaaacagcgtaactacaatactacaaaggaaaagaaaaatcatcctgaaagattagaaaccagaaagtattgcagattctgtagaaagcatactgttcataaagaaacaaaatagtcggaccggtttttaaggagtgataagatgagcgacgaagcaaagaaaacagaaaaaacaagctggtttcagggccttaaagccgaatttaaaaatatcagctggcctgacagaaaaacgcttatcagagagacaattacagtaacggttgtatccgttgtcctgggtgtcattattgctaccctggatatggttctccagtatggaattaattttctggtctagtataaaggtaaaggtgaatatatgtcagaattaaactggtatgtggtccatacttactcaggctacgagaacaaggtgaaggctaatattgaaaaaacaattgaaaacagaaagcttcaggatcagatatttgaagtaagagtccctcttcaggacgtagtcgagatgaagggtggagtcaaaaagaacgtatctaagaaaatgttccctggctatgtgttagttaacatggtcatgaacgacgatacatggtatgttgttcgtaacaccagaggtgtaacaggctttgttggtccagggtcagacccagtaccactttccgaggcagagatgagaaatcttggtattgttgcccagagcgacaatgaagtagagattgacatcgagattggtgacttagtagaagtaacatccggtgcctgggaaggaagagtaagcactgtaacggcaattaacatgaataaacagactgttaccatcgaagtagatatgtttggtcgtgaaacatctgtagaaattggatttttagatgttaagaagttataagatactccgtaaggagcagaaaagtgggagggacattcccgcaattaccacaataggaggttagctatcatggcaaagaaagtcacaggttatattaaattacagattccagcaggaaaggcaactccagcaccacctgtaggtcctgctttaggtcagcatggtgtgaatattgtccagtttacaaaggaattcaacgctagaacagcagataaaggcgatttgatcattcctgtagttattacagtataccaggacagaacattcagttttattactaaaacaccaccagcagcagtattattaaagaaatactgtaacatcaaatccggatcaggtgttcctaacaaaacaaaagttgcttcaatttctaaagataaagtaaaagaaattgcagagatgaagatgcctgatttaaacgcagcgagcatcgaagcagcaatgagcatgatcgctggtactgccagaagcatgggcattactgtagaagattaatcggattgattagatacaacgaagtgggagggtcgctcccgataataccacaggaggttatttagaatgaaaagaggaaaaagatatcaggaagctgcaaagctcagagataaaactaacttatacgacgcaccggaagcagtagccatcgtaaaaaaagctgccagtgcaaaatttgatgaaactatcgaagctcatttcaaaatgggtcttgacggacgtcatgctgatcagcagattcgtggagcagtagttttacctaatggtacaggtaaaaaagtacgtgttctcgtattcgctaagggtgacaaagctgaagaagctgtagcagcaggagcagaattcgtaggagctgaggaacttattccaaagattcagaacgaaggatggttcgatttcgataaagttgttgcaacacctaacatgatgagcgttgttggtcgtcttggtcgtgtacttggaccaaaaggtttaatgcctaaccctaaggctggaacagtaacaatggacgttgctaaagctgttcaggacttaaaagctggtaagatcgagtacagacttgataaaacaaacatcattcacgtgccaatcggaaaagcttctttcacagaggagcagttaaacgaaaacttccagacattaatagatgccatcattaaggcaaaaccagctgcagctaagggacagtacattagaagtgctacacttacttctacaatgggtcctggcgttaagctgaatccagctcgtttctaatttactaaatagtaattgggctaaacaaacgaaacaaaaagcaccatagtattctatctgtgattttaatcacagatagaatactatggtgctttttgttttctattttcccatcccctctattcccagtcattctcgagtaagtagaagactcggcatctcgttcctaaatccttccactttctatttaattcattaagtaaacaacagacgaagccagtgaacttcataagccatatttgtgcttttagtcgcggcgcgttgaatgttcgctccacgcgctcgcatccaacacttgctccgagaccacaaatatggcttatgaagttcactggcttctgtgctgtggctggagaaaatgaattaaacaggggggaggggatttggggacagaagctgatgtattctgcttactcgagaatgactgggaatagagggggatgatttaacttttttaacgattgtcacagcaatatttcaataatttcagaacaaaaaacaggcttctattctcaatctcagttctttaacaaatccatttaaatactaagtatctattcataatatttttagagtaagcagaaaatttctgccctctcccccaaatctccgcaaccactatttaattcaaacaaaatccatccaaagacagcccgggaagagaaccgataccctatatttgtggcctcggagcaaggtttagatgcgagcacataaagcgagcatttaaaccgccgcgactaaagtcacaaatatagggtatcggttctcttcccgggcgtctgtttgtctaacgaattaaatagtaaattaaatcagtggacgtatatttttgcagagtgtataatggacttataaattttacagggaggaataaaaagtgaagaaaatgatgaaaaaaacgtttagcttgctgatgatttttatgctggtttttactatgattccgacaagtacattgaaagtatctgctaaagcagcggcagcgactacacaggcaaagaaagcaacaacaaagacagcaaaaaagacagcaaaaaagaaaaaaaagacaaaagcaaagaagcagagaactgtatttatagcggctggacaccagcagagaggaatctcttctacagaaagattagcgccaggttcttccagaagaaaagcaaaactgacatctggtactgctggtgtacgtacgcatatcccagaatataagactaatcttgcaattgcaaaagcgacaaaaaaagagctgaagaagagaggatataaagtaatcatgctccgaacaaccaataattgtccactttctaaccagcagagaacaaagaaagcgaataagagtggtgcggatatccatatctgtattcactgtaatgcatcaggagcaagtgcgagaggtcctttggtttgtgttcccggaagttcacgttatgttggaaagaagatatttaacagttcacgccgtcttggaagctgcctgttaagttccgtagcaaaagctgtgaataagaaaagtcacggaacaatccgctcagattattatacaactattaactgggcaaagattcctacaatgattttagagtgtggtttcctcacaaatccaacagaggaccgtcagttgaattcttcttcttaccagaagaaacttgcgaagggaattgcgaatggcgtagataaatatttcaaatagtatcgttttatgtagtacctgcatttacaattctatcttttcatgctataattcttgattggtttgttttagagagcgtgtgtggttcatatcttgcagaaagcatttatgaaatacgtttgagaagtacaaaacaaaaacaagattaaaaaatgtaatatagcaaattacataaaatacataaggaggaaaagatggaaaatcaggggaacatgcagagcaggaaaaaagcggcagtaatctattttctggccgctttttttattgcgtgcataggaattgcaggggccaattatttaaaaggagagcttggcctttctgctgaagaattggtaaaaaaagtggaactgactgtagaaatagcagtattattaggaattgcaatagcagtacgtcatctgctaaagaaaagaaatagaaagatagcaggtattattgttcttctttttgttgcgggagttttttcatggcagaattctggaatctggcaggaaagccagttgaagccgcagcgattagaaacaccggaaagtgaatttgatcgttatgatattaaagatggtcattttacagtagcagaggcaaacgcaaatattgtaaaagaaattaatgtagattatcttgataatgttacggtacatttttcaaaaccagttacacagaaagttattgtgcgtgttctgtatgagacaaagacacagcatggatttgataataaaacaagaaaaatgcgtgtaaaagttcataagggagagacagtaggctgtgtttcaatgaaagtaaaagatgttacgagaattaaaattggtatcggaagaaagattggaacacagtttgattatggatataccgaaatcaatggaaattatgcggcacgtatgcatcaaaagaaagtcagcatggtgaaatattttgtgtttttcatgctgattccggcaggatattttatattagcagcaggaaagaagtggcaggagaaaacggataaaaatatttgcctgcgaattttatcttttccatttggatttataacaattctttcattatttgccaccttccttgtagtgaatttagtagaatgggtgaagatgacatgtggaaatgtttcattttccattatccttttacagcttacaagtccgataaaaggaacagatagcggaattataaacagtatcatcaagactgcagtagttcctccggtacttcttgccgtagcagctgtactgtgctatcttttcattgtgcggggaatgtatgcattagaagatcttccagtgaagaaaattccaagatggagtaagatttgtatagaagtagttatggttgtattttttctgcatactgtacaggtacagggaacagagataggtatgtgggattacatacaaagtgtgagggagagttctgatttttatgaaaaagaatatgtgaatcctgcaaaggtaaagatgacatttcctaaggaaaagaaaaatctgatttacatatttatggaatctatggaaagcagttacgcagataaggaagatggtggaactatggatgataattatattccgaacctgacgaagcttgcaagagaaaatgtatagtttactgataagaaagatggaaaagtgggtggacctgtctgtttagaagcaacagcgtatactgccggtggattggtagcacagacatctgcaattaacttaaaagtaatgaattctggggcagtatctgactcattccttcctaacctgacagcacttggtgatatccttaacaaacagggatacaatcagatgtttttgtgtggaagtgatggagattttgcagggcgagatgcctattttaaaacacataaagactatcagattgaagattataaagccgcaataaaagaaggagatatcccaaaagattataaagtgtactggggtcatgaggataaagttctatatgaaagagcaaaaaagaatctgaaaaaattatctaaggaaggtaaaccttttaatcttactatgctgacggtagacacacatttccctaatggatatatttgtgatttatgtgagaacaaatacgataccacttacgggaatgcagtagcctgtgcagaccgtcaggtttacgactttgtacaatggataaagaaacaggacttctatgaagacacgacaattattattgccggagatcatacttctatggtagatacaggaagtaagttctggaaaagtttaagcaatgactatcagcgtacggtatataatgcaataattaatccgcaatgtgcatataagaaaaaagttacgacaaagagaaagttttctacaatggatatgttcccaacaacattggcggctcttggtgtagaaattgatgggaataaacttggattaggaactaatttattttcaggagaagagacgttgagagaagaattaggtgctaattatattaataaagaactgaaacgaaacgataaaatgtataatcagttttattaggagaagattgaaacagatgaataagcaacaaaagaattatataaaagctgtagtaggatttgttttggctgcaataatcctctgtgcaggaatcatgactgccctttatcttatgagagaagaaaaaggaatggaaaacctgatggcaccagtattaaaaagactgattgcaggcattttgctctttggccttactgtgtgttggagacattttttaaaaaaatctgtcagtaaagtagcagggataatagttattgtgcttcttagtttattttttgcatggcatatttctggaattccgcaggaaaaagcattaaaaccgcagaatgtgaatctggaaaaagcagaatttcgtgggtatgagataaatggaaatcattttcttattaaagaagcaagaccttttataaagtataagatgcagtcctcgaaaattgccaatgtaaaagtatattttgaagaaccagtggcgcaggatacagatgtaaaaatttcttaccagaccaaagaaaagcctacttatgaacagaacccaagagtatgggctaatataaaaaaaggagaaaaaatagcatttggagagatagatgctactggaataacaaggataaaagttcgttttggaagcaagatagggcagcagtttgtattagatcatatagaattaaatgcaaattacagggagcgtgtgcagaaaaaacagataacaatgataatttattttatgatgtttttgcttatgccggcttgctatttgctattatctcatgcggttgaacttcagaagaggacggatcagaacaaaatattgaaagtattatcatttccgtttggtttattagttccggtagccttatttataacactgctggtatgtagtatggttgcatggcttaaaagtacatgtggggatgtttcattttccattattgtgctgcagcttaccagtccgataaaaggaacggacagtggcgtaataaacagtattataaaaacaggaattattccgccgctccttgttacgcttacgattagcatagtttatcttattatggtaagagtattatacaatcttgaagatttacctgtaaaaaaggttcctgcatggactaaaatctgtctggaaattattctgctcattgccctggttggaacaatacaagttcagggaacaaaagtaggtatgtgggagtatataaaaagtgttcaggagaaaacggatttctatgaaaaatattatgtaaacccagctaagacaaaacttgattttccatctcaaaaaagaaatttgatttatatatttatggaatcaatggaaagtagttatgccgatcaggaagatggcggtatcatggatgataattatattccgaatctgacaaaattggcgaaggaaaatataaatttttcagataaggcggatggaaagctaggcgggccaacttgtttagaggcaacggcttatacggttggaggaatggttgcacagacagcagcaattaatttaaagcttcataattcgggatctatgtttggaaactttcttcctaatttaacaacaatgggagatattcttaataaagaaggataccagcaggtgtttttgtgtggaagtgagggagactttgccggaagagatacatactttacaagccacaaagattttcatatagaagattataacgcagcgaaaaaagaaggattcattgcgccggattacaaagtattttgggggcatgaagacgaaatattatataaacgtgcgaagaagcagctcgaacagctttcttcgtctgacaaaccatttaatcttacaatgctgacggtggatacgcattttccacgaggttataaatgccgactttgtaaagataaatataacagacaatatgctaatgtaattgcctgtgcagaccagcaggtatatgactttgtagaatggataaaaaaacaggatttttacaaaaatacgacaattgttatagctggtgatcatacgacaatggtcgatacgtccgatccgatatggggtaatttaaataataattataaaagaaccgtgtataatacaattatcaatgctgattgtacctataaagaaaatgtgaccgaaaacagagatttttctacaatggatatgtttccaacgacattagcagctttgggagtacagattgatggaaatcgcctgggattaggaacgaatctgttctctggtcaaaaaacacttccagagaaattaggaagaggatatattaatcaggaattaaagaaaaacgacaaagaatataatggattttattaacttctgattgtgcagcaagggagacgccctctgggaatgaaataaggattatttcattcccagagggcgtctcccttgcctgcggcaaatcagaaattatttcgtcagaatggagagtattttattggaacgtgcaacaaatgcagtcatctcttccggtttcagcggatggtttgccagacgtgcaaggtcatagagctgctggcagattgtagtagtattttcgctttcgtcattgtttaaaacatactgaactaagtcattgttcatgttaaggacgagagtttcaccttctgcaccaagtcctgtggagctgttgctcattccgtacatttccatcatttcggacatacgacgtgtttgttcagaaacggtgatcatagaaggcatatcggcatttttcagcttttcaacttttacgattaagttttcaacaccagttgcctttttgaacttctcggaaagcttttcagtgagttctttttcttcgttctcatcaattgtttctttgaagttatcagtcagttcagagtcgatacgcaggaattttacttctggatttctctgctctaagtgagtgataaatgttgtatcaatctggtgtgtcaggtagatggcatcaatttcctgttctttgaacatattgatatactgagactgtgctacttcatctgtgatatagaaaacattgttttcgtatttttctttaccagcttcaagataatctggaagtgtaacatatttgccctccatgttcttgaagatgatgtaatctttcatcttatcgttaaatttctggtcacggatgcagccaaacttaatgaatgggctgatgtcatcccagtatttttcatagttttcacgatcggtcttgcacataccggaaagcttttccgcaactttcttagtgatgtagttagaaattttcttaacaaaaccgtcattctgtaatgcacttcttgatacgttcagtggaaggtctggacagtcaatgcatccctttaataataagaggtattcaggaataacttctttaatattatctgcgataaatacctgattgttatataacttaattgttccctcgattgtatcatattttgtattgattttagggaaataaaggataccttttaagttaaatggataatccatgttcaaatgaatccagaataaaggctctttataatcgtggaatacatcacggtaaaattctttatattcttcatcagtacagtcgtttggatgctttgtccataatggatgaatctggttgattggcttaggtgcatcatcttcttcctcttcttcctcttcaagagttacttcggaatcaccatcttctgtatcagcgttattttcttttgcatcagcgtcctttacgtctacgtcaattaccttttcttcagcatcctttttggcagcttcctcagcctttttcgcttcttcttcctcatttacaaagtaaatttcaactggcatgaaagaacagtatttgttaagaacttcgcggcagcggtattcattacagaattcataactctcatcgttgaggtaaagagtaattgttgtaccacgctctgctttgtcaccatcttccatatcaaattctgtaccaccatcacattcccagtgaactggtgtagcgccttctttataagaaagagtatcaatagtaaccttatcagcaaccataaatgcagaatagaaaccaagtccgaaatgacctataatctgctcatcacttgctttgtctttatactgttccatgaaagcagcagcaccagaaaaagcaatctgattgatgtattcgtctacttcgtcctctgtcataccaataccattatcaataaaggtaagagtcttgtcagtaggattaatacgaacttctactttatacttctcatcgtcagcttcttcaaattcacccataacagaaagctttttcagctttgttacagcatcgcatccgttacttactaactcacggatgaaaatgtcgtggtcagaatagagccatttctttataataggaaaaatattttcactgttaattgataaacttccctgtttagccataataagcatctccttaaaattaattatataaatgtaggctaatattctatgaactaagtcaaaaaacttctgactggaatattgcctttgtatttttatcaataccattcttatactaataccagtttgcaggaatgtcaagaaaaaattagcactcaatttaaatgagtgctaacaattgcgttttgccgcaggcaaaggagagacgtctttcttggaaactgtctttggtaattggagtaaatgtaggatattgctacattatgccagtagtttgagtattggccctttcaaatttaatttcctaatgagtacaattttctgagaaatccccaaattgtcaaacaataactttaccaattagtttcctggttagcctgtcgcttttgtttagctcaacaaattactattaaatttattactactttcgcaggtaggataagtatgatataatttaattcgttattattgcgagaaaatcataattcgttatagagaatacatagaaagtaaggtcgaggaaatatgaatcaggaattaatgaaggaatttaaagcagatttaaaagaatttcgagagatgacagagaaattttatgcaaaagaagtcagtgtgaaagattataaagggttctctggcggctttggaagttatgcacaaaaaggtggagaagcgagcatgctccgcctgcgtatgccaggcggcagagtgacgaaggaaaagttaaagttcctcgtagattctattgaaaggtatgatgtgaaaagagcacatatcacaacttgccagacagtgcagtttcatgatttagatgcaaaggcggtttgcgatattatggagcaggcaatggatgctggcattgttactcgaggaggcggtggagatttcccaagaaatactatggtctctcccctctctggggtggaacaggggaatatttcgatgtacttccttatgcggaagaagcgggagattatctgatgggaatcatcaagacggtgaagcttccaagaaagttaaaagtaggattttctaattctctggcgaatgtaacacatgcaacatttagagatcttggatttgtagcaaaagaagaaggaacttttgatgtatacagtgcaggcggactgggaaataattaccgaatgggagtaaaggttgcggaaaatgtaaagcctgaagaggtactttattatgtagaagcaatggttcggacatttactacttatggtaattatgagagtcgtgctaaatcaagaacaagatacatgcaggagacattaggggtagatggctaccgcaaagcatatcaggaaaagttagcagaagtaaaggcagaatataaagattctcttcttataaagttagaaggaaaagtagccgaaaatgcaataaataatatggaaaataatagtgcggatgatgttgaaggaaaaaacactgctgatatgtcagaaaatataacagagagcataaccaagaatgtagcagacaacatagtaaaaacggatgaaaatgttatattagaaacagcagaaagttatccacaaaaagaagcagcatcagaacgtattcttccacagaaacaacagggactatatgcagtggcatatcacccaataggtggaattgtcccagtgaagaagtttggagaaatttataatataataaaagatattggagacgcagaagttcgcattgctccagatgaaacattgtatattattaatctgaatgcgtcacaggcaaaggagattgctgcaattacagaagacggggcaaaaaacttgtttgaaacatctgtatcatgtattggaagtaccgtatgccagattggacttagagattctcagggattgcttgcaagtattgtggcgacagtagagccttatcattttgcagatggggtacttccaagaattcatatatctggatgtacttcttcttgcggaacacatcagatcggaaagcttggtttccacggggcatctaaacgtgtggatggaaaaatgcagccggcatttgcttttcatgtaaatggaacagatgcacagggagcagagcattttggagaagaatggggaacaatgcttgcagaagaaatcccagatttctttgtagaacttggtcagatgatttcggcagagcatttaacctatgaaagctggtatacccaaaatccagaaaaacttaagaaaatagcagaaaaatatattcgttaaaacaatttaatgtactctcggaagctttttgtgcttgattttgtgagaagattttttgtaagttgtgtccaaatttctgaagcgtacgcggtacgtacgttgatgaaattcgggtgcgactggcggaaaatcagccacaaaagcaagtgcaggaaagactccgagagtacattttattaaaagtaataaaaaagtatcgtctcacctctttgatgcggtacttttttattttttgcttttaataaattgagaagaagtagtgttatttttccttcagatatatcagatgtgagatgactcccacctgtaggtggtgagcaacaaatcagtatcagtgggggcttcccgatttctacaggtggggaagatgtcacttccaaagaaaaaattcaataactttgataaaaaattatcaattggtaaaaagaaaaaagcaaggaaaaaacaggttaggcgaaatgaaaagtaagatattaggaatactgatcacactgctttttgtggcaggatatgcgacgttgaattatccggtacttgggacgctttataatcagattcgtgagggaaaggtaatagattcttatgatcatgcagtccatacgatgaatgagcagaagcgtaaaaagtattgggaggatgccagagaatataatgagagactggcaagagagaatccacagctttcagatgcattttcacaggaagagaagaagccggacagcgcatataatcatattttaaatatggaagaaagcggtgttatgggcgctttggagattccaaagatttctctgtatctgccaatttatcatggaacttctcaggaagttctggaaaaaggaatcgggcatcttgagggaagttcgataccaattggagggaagaatacccatgcggtattgaccggccatcgaggacttcccagtgcggaacttttttctaatttagatcagatggagcggaatgatgaattttacattcatattctcggtaagacactggcatatagagtgtttaatgtagagacagtgaggccagaagaaacaggacatcttgccattgcgagagggcaggacagggtaacattggtaacatgtactccgtatggaattaatacgcatcgtctgttagttcacgcaaggagggtaccatataaggagaagagcagcagttctcgaaagaataatttatggaagtggctgttgaagcaaaaagtcttgttgatttcaacggggattcttatacttttaattatttacagcctggtgcgcagcaggaagaatagaaagcgaaagaaacgcaggcataaaaagaaatcaggcggtaacaaaaagaaataagaaggtataagaaagaaaaggaatataccataatgaattattaaaaaggaggcacagttgatgaaatctataatagccaggaagtttagtaagtatattggcgctttttttgctatagtggcgatggtggcagggttgttgctgccagcgcagataaaagcagcagatagctataataaggacaaaaaaggcagcataacgattaatttggatgatgtaaagcaggaagacagcattacgaataagagtggagtttctgtcagcatttatcaggttgcatctatcggtcatgacggggtgaatatttcttttgatattgcgagttctttagaatctacaggtgtagatgtcaatgatattacaacaagtgataagaacctgaattcggcgaagaagcttactactgtcattgacaattccggtatttcatcagtaacaaagaaaacagatagtaacggtaaagttagttttacggatctggcgcagggaatgtatcttgtcgaagaaaaagacagcgcttcttatgggatgttttctccatttttagttgcgattccatatatggaagatggacagaactggatttatgatgtggagacttataccaagggagtaagtaatcagcagggttctttagaagtaacaaaggctttagtttatatggatccggaaacagggaagatttataatctgcaggcgccgaaatcttatgaagagaatggagagactgttccaggagcaagatattatgttggattgttctgcgatgccgaaggaacgattccttatggaaagaattacttgaagacaattgattttaatggaagccacagtgagacaataaagtatgataatcttccagacggtatttattatctgttcgaaacagatgagaatggtgttccatatgctatgggagagacccatacagagaaggatagaacatataaatgtgtagttggagatggctccggtgattctgcagataataaagtgcagttacagggccgtccacagggaaagatgaatatcagtaacgtatttactattattcctgatgatttcgtggttgtagcagagctgaccattgagaagaaggtgcttgatcagaatggacagcagacaacaacaaatgatacgttctatgcttctgtctacaagcagacaggttcagacgataatgtagagaatgaacttattcagacagtacagttacagcagaatggtaaggtgactgtacctgttcgagttgagaaggatggcagcacaacgaaagtttacatagaagagacagatgcagatggtaacacgattgatccagataattttgcttataagatcagtggtgagggcaatgtagaattatctatggaacagcaaactggtacgatcactcttacaaatagagaaaaaggtgacgaggaggaagagacaacttctagtgaagaggagactacttcaacagaaaaggaaaagacaccacctaataataagaagaagaagtctaagagtggtaagactggcgatactacaccaatcctgacatggattatcattggagtggctgcagccgttgtgattatcttccttgtagtaagaagacgaaaaagtgaataaagcgtgatatagcgttttcagtatgcagatactttccgtatatgagtgaattggttgccattttttaactacattttatggatatcactgataataatatatagttatactgaattttaataattttaaagcaagtagaaagattctacttatatccttgaattcctacaccagccaatttgattcaaacaaaatcaagccaaagaaagtacccgaagagagaagccgccctatatatatggtcttagaacgaggactgaatgtgagccgtcaagcgaacattcagcccatagtgatagagtcacagatatagggcggcttctctcttcgggtgcgtctatttcttatatgaattaaatcagaacaaatatttggattttgtctgtacatttgttcgtatatttgatataatcggaaacatactacgataagagggaggatttgcttcatggaccatttcgaattagtgtcggacttcgcgccgactggagaccagccacaggcaattgaggagctggtaaagggatttaaagaagggaatcagtttgagactttgcttggagttactggttccggtaagacatttacgatggcgaatgtcattgcacagttgaataagccgacgctgattctggcacataataagactctggcagcgcagctttacagtgagtttaaggcattttttccacataatgcggtagaatattttgtgtcttattatgattattatcagccggaagcatatgttccttctacggatacttatatagagaaggattcttcgattaatgatgagatagataagctgcgccacagtgcgacagcagcgctgattgagaggaaggatgtcattgttgtgtcatcggtttcgtgtatttacggcattggtagcaagaacgattatgcgaagatgatgatttcgctgcgccctggaatggagattgacagggatgaggttgtgcgccgtctgattgatatccagtatgtgcgtaatgagcttgattttaagagaggcagtttccgtgtacgtggagatgtgctggaagttgtgccggtttcttcttttgaagatgcgattcacattgaattttttggtgatgagattgatcggattatgcaggtcgatgtgctgacgggagagattaaggcaagtcttaattttgcgattatttttccggcttcgcattatgttgtgccgcaggaacagattgagcgtgcggtgaagacgattaaggaagaacttgacgagagagtggaatattttaaggagaacgatcagcttttagaggcacagagaatttcagaacgaacgaattttgatatagagatgttaaaagagacaggattttgttctggaattgagaattattcgagacatcttacgggattagagccgggaaaggctccgtatacgctgattgatttcttcggggatgattttcttatgattgtcgatgagtcacatattacaattccgcaggtgcggggaatgtatgcaggagaccgttcgagaaagcagacattagttgatttcggatttcggctgccttcagctttagataaccgtcctcttaattttgatgaatttgaggagcggattgatcagatgctttttgtatctgcgactccgaatgtgtacgagggagagcatgagatgctccgggcagaacagattatccgtccgacaggacttcttgacccgccgattgatgtccggccagtagagggacagattgatgatttgattagtgagattaataaagaggtagcgaagaagaataaagttctggtaactaccctgacgaagcggatggcagaagatttgactgcttatatgaaagaattggatattcgtgtgaaatatcttcattccgatattgatacattagaaagaattgaaatcgtaagagatttgcgaatgggtgtatttgatgttcttgttggaattaaccttttaagagagggattagatattccagaggttacgctgattgctattcttgatgcggataaggaaggatttttacgttcagaaacttctcttgtacagacaatcggacgtgccgcacgaaatgcagaaggacacgttattatgtacggagatacgattacagactccatgcgtgccgccatcacagaaacaaagcggcgtcgtgaaattcagatggcatataatgaagaacatggcattacgccaaagactattcaaaaggcaattcgggatgtcatttctattaccaatgaagaagcaccagagaagagccgaggttccttaaagaaagatatggaatctatgaaccgtaaggaacttacggaaatgatagctaagttaacaaagaagatgaataaggcagcggcagaactgaactttgaagaagcggcagaattaagagatgaactgaaaaagtataagattgctttgagggattatgacgattagaaaggatacaatataatgagcgaaaagaaagaatacattcgcattcgaggggcgcgtgagcataaccttaaaaatattaatatagatataccgagaaatgaatttgtagtactgacaggactttcaggttctggtaagtcctcactggcatttgatacgatttatgcggagggacagagaagatatatggagtcactgtcttcgtatgcaagacagttcttaggacagatggaaaagccggacgttgacgatattcagggtctttctcctgccatttcgattgatcagaagtccacgaaccgcaatccacgttctacagttggtacagtaacggaaatctatgattatctgcggcttctttatgcgagagttggcattcctcactgtccaaagtgtggaaaagtaatttccaagcagacagtagaccagattgtagatattttaatgaagcttccagaacggacgaaaattcagcttcttgcaccgattgtaagaggaagaaagggagaacatgtaaaaatattaaaagacgcaaaaaagagtggctatgtccgtgttcgcattgacgggaatctgtatgaccttgcagaagagattaagttagaaaaaaataaaaagcacaatattgagatcattgtagaccgtttgatgataaaggaaggtattgaaaaccgtcttacagattcgattgagaccgtaatgaagcttacagggggacttttgttagtagatgttgttggtggggaaccgatgaattttagccagagtttttcctgcccggattgtggtatcagcattgatgagattgagccacgaagcttttctttcaataatccgtttggagcctgtccagtctgtcacggacttggatttaagatggagtttgatgttgacctgatgattccagataaaaaaatgagtattgcagatggggcgattactgtattgggctggcagtcttgcacagatccaaagagttatacgagagcagttcttgatgcattggcaagagagtataattttgatttgagtacgccattttgtgatttaagtccggaagtccagaatattattattcatggaacgaatggacatgaggtaaaagtatactataaaggaaagcgtggagaaggtgtctatgacgttgcttttgagggtttgcttcgtaatgtacagcgtcgttatcgcgagaatcattctgaacgtcagagagcagaatatgaaaactttatgacagtgactccatgtgatagttgtcacggtcagcgattaaagcctgaatctctggcagtaacagtaggtcagtacaatatttccgaattgacatgcctctccgtaaagcgattaatttcctattttaatgaaattgaacttacagaaagacagcagcttatcggtaaacaggtgttaagagaaattcgtggaagaatcggctttttaaatgatgttggtcttgactatttaagtctttcacagccaacagggacgctttctggtggagaagcacagcgaattcgtcttgcaacgcagattggttctggacttgttggagtggcatacattcttgatgaaccgagtatcggtctgcatcagagggataatgacaaactcatttctgcattaaaacgtctgagagatttaggcaattcacttattgtcgttgagcatgatgaagatacgatgcgggaggcagactgcattgtggatattggaccaatggcaggcgaaaatggtgggaaagttgtcgcagttggaactgcagaagaactgatggcgaatccagattccattacaggagcataccttagcgggaaaatgaaaatccctgttccagaagttcggagaaagccgcaggggtatctgacggtgaaaggagcctcggagaataacttaaagaatatcaacgtgaagtttccaatcggcgtatttacctgtgtaacaggagtttccggttcaggaaaaagctcccttgtcaatgagatactctataagaagcttgcctgcgtattaaaccgtgcaagaattaaaccaggaaaacataaagatattgaaggaacagaacagttagataagataatcaacattgaccagtctccgattggacgtactccacgttctaatccagccacttatacaggagtatttgatcatatccgtgaattgttcgctatgacaaaagatgccaaagcaagaggatatgacaaaggacgtttcagtttcaataaaaagggcggccgctgtgaagcctgtgccggtgatggtattttaaagatagaaatgcagtttcttcctgatgtatatgtaccatgtgaagtctgtcatggaaagcgttacaacagagagacattggaagtaaaatacaaaggcaaaaacatatttgaagtattagatatgaatgtcgatgaagcatgtgaattctttgagagcgtgccatcaatccgaagaaagatagagacacttcgagatgtaggactttcctatatcaagttaggacagccatcgacaaccctttccggtggagaggcacagcgagtaaaacttgccacagaattaagccgccagagtaccggaaagacaatatatgttttagacgagccaacaacgggactgcacttcgccgatgttcataaactggttgatattttgcagcggttaacggaaggtggcaatacagttgtagtcattgagcataaccttgaagttatcaaaacagccgattatatcattgatatgggaccagaaggtggcgaaggcggcggcacgatggtgacttgcggaacaccggaagaagttgctgcggtagaaaaatcttatactggaaaatatctgaaaaaatatttgaatcctgatttgccgcaggcaaggtagacgaactcagggagataaatggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaagggcatacctatcgaactcctgctcaaaaagaagccgctgttttcgattacctttctggaaaaggttctctccgggatatctgtgcccggcacaaaatttcagatgcacagatactcagaagatggattatgaagtataatagtcatgataaggaaacaggaggtagagcaatcatgactaaaggcagaaaaactacatttgaagaacgtgtcgagatcgttcaatattgcataaaacattctcataactattcggaaacagcaaaaaaatttcacatttcttatcagcaggccagaagttatactataaaatatgaagaaaacggggtggatgggctgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatctggtccaacttaaagagccggtataatggctgtaccagagcctcaaacaacccagcatttattgcagaaaacattcttaatagagaatttaaggcggaacaccttaatgagaaatgggttaccgatgtaacggaattcaagtatggaaataccttagacagtgtacataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccaaaataaagcatatttgtgactttagtcgcagcgtgttgaatgttcgcttgaacgcgctcacatttaacacttgttccgagaccacagatatgctttatttatctccctgagttctgctcgttggcagcttggaaaatcagtttaaaagatatttttcacaaatagttccagtctcaatctttcagaaggacaatcccccgtaaaactgcaattgtctgcggcaaatcaggattaatcagattctatttcgtatgtaaatcctgcatcagtaattgtttttatcgtatcagagattccctgtccatctgccgtgagataaccggaggcaaagatagagtctacgatactgagaagttctttttcacgtcctttaaagtaaacttctcttccggcagcacatcggatatcggattgtggagccattaatctggcaaggcacagtactttcatacagtaagctggtgtgaggacagaagtatctgcattttctaaaggagtccctggaattgggagaaggaagttgattggcagagcctcgggctgaatttcacgaagatcgaggagcatatctacaatatcttccttactttcacccataccgataataccgccgctgcaaatttcaaaaccaagtctttgtaacatatggatattatttacacgctgttcataagtatgagtggtacatatattatgatagtaggaacggctgctgtttaaattatgattaattcggtcaagaccggcttcttttaacattaatgcctgcttttcagtaagaaaaccgatggaacagcaaagatgcgttccctgcgctttcataacacgaattttttcagccagttcttctatttcttcatcggtaaacttcattccgctaagaccaatacagtgtctggaaagatggttatcatgcacaaatgcattatcactgtataacttttcatcatttacccatttatatttttcaatttctgcttttgaacggcaagactgggcacaataagcacaattttgagaacagtttccactgcgggcgtttgtaagaagatgaatactcacatgattgcctttatattttttacgaagacttccggccatttccataagaagaggcatatcgtcttctggaagattcataatagcgatggcctcctcgcgtgaaagagaatattccttatttacattttttgttaatatatttttaattgtgtcaatagttactgcttcactcataatgaatcctttcttaacctcacaaaatagcttccaaaatgaaagcacgataattcttattgcattttatttctaaaattctcttatttgttactgtaacatggtaaaaagatattgtcaaccgtaataaaaattaaagttaacaataagatgttgctatttaattcattaagaacagacgcccgagaagagatacgatatcctatatttgtgactttagtcgctgcggtttaaatggtgtgcatcccgtcaagtagacaattaaaaaaatataaaatttttgtgttgcccggtgtatatcgggcaacatttttatgccgccaatcgttgcttttcatgaaattccattggtgttaagactccaagtcctctctgtggccggtcgtttgtatagtaatctatatattctgtgattgccttctctaattcttctctgctctcaaattttttcccataatacatttcccgtttcaagatcccccaaaagccttccattactccgttatctgtacagtgtgctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcattaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtgccgcagcttgtcatttaaccttctatatcccatatctggatgtttttcatggaatcgttccagcttctctgccaattcctcgttaaatctctcattcggtgtctctgcatgatggagccatttgtagtaggatgacctggcgatccctcctatttcacataataacaggattggatagttatatttttcgtgttctttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagtccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccaaaatgctcgctttatgcgctcacatctaaaccgcagcgactaaaatcacaaatatgccttattgggggcaatggcttcgtctgtagttcgcttaatgaattaaatagtaaaataacatattttggttgtagccattttttataattatggtatactgtgttttgagaggtagtgaatggaatttaattttaaatgtagaaatgataccaggttgaaagtgaatggggagaaatgaatggataaaattggacatttagttatgacaaagtcattatcgggaaatatacacagagcacataaagcagcattattgtttggaagtattctgccagatctgctggtgtatacttatctggagggtcatacatgggaagcaacgttcgaacagattacaaaacagatggaagcgttagaggcaaaaggaagaggcggaagcttttcttatttaaaacttggatggattcttcattatgtggaagattattttacctatccgcataatacgatttttgagggaacaattccagaacattatgcttacgagaaaaaaatgacaaggtggatgagggagggagctttagagcagatgtcccttccgatgtgtaaaaggcttgattctgctgcggaagtggaggagagacttcaggaattacatgacagatacctttcacagaaaatgtgttatgagaatgatatggcatatatgcggcagatggtttcggaaatattgaattgttatgccgagatttttgtgagaaagagcgagttcgcacgttttatggaatgggtgcggaagaaagttggaataatgacgggatttgtttcttagagtgtgtttgaaaaatttttatatagttcagctaaatatgggaaacttgttttgtgaaataatcggcgattgaattacagaggattcctgcctgacttcctaaaagaagccatagagcgtgtttgaaaaatgcttttttcaaacacgctctagtatcttttacttaaaaaagttcagaacttcttgcgtgaaaatccagaaatgaagtgaattgaatttaaaatttatttgttcctataaaaatgcaagaaaaagcgcaaaaaacattgacaaaatgaaggaaaaggattataaaacttcatgtatacaagaaatggcttgtatacatgaaaggagaggacaaaaatgaatacattagtcattgttttaattgctgctgttttattgacagttgcatatgcattttatggacggtggctttctaaaaaatggggaattgacccaaaagcagagacaccagctcataagtttgaagatggacaggattatgttccaactgacggttggacagtatttagccatcagttttcatctattgctggagcaggccctgtaacaggagcaattcaggcggcagtatttggatggcttccagtacttttgtgggtattaattggaggtattttctttggagcagttaccgactttggagcattatatgccagtgtaaaaaatgatggtaagtccatgggacttctgatcgaaaaatacatcggtaaacttggaagaaagttatttcttattttctgctggctgtttactttaattgttatcgcagctttcgctgatatggtagcaggtacatttaatgcttatacggtagatgccaatggtgtgattgcactttccgatgcagcaaaaacaaatggagcagcaggaacaatttcccttttatttatcgcatttgcaatgatttttggtttacttcataaacatctgcatctgacaggatggaaggaaacggttgttggattaatctgtactgtagcagcacttgctattggtatgacaatgccaattacattaggaaaggacggctggacatatattacatttgtatatattttctttgcggcagtacttccaatgtggttattaaaacagcctcgtgatgcgatgacaacctatatgtttattggaatgatcgcaggagctgttgttggattattagtagcgcatcctacaatgaatcttcctgtatttacaggcttccataatgatcagcttggtgatttattccctattttattcgtaaccgttgcttgtggagcagtttctggtttccacagtttagtatcttccggaacatcttcaaagacggtatccaatgaaaaagatatgttaaaagttggttacggcgcaatggtattagaaagtttacttgcagttatcgctttatgtgtagcaggagcggcagcgtccgctaacggaacaccagcagatggaacaccattccaggtattctcaagcggtgtagccggattctttgaaatgtttggaattccagtatatgtagcgcagtgcttcatgacaatgtgcgtatccgcgcttgcacttacaagtttggatgccgtagcgcgaattggccgaatgagtttccaggaattgttcagtgttgatgatatggaacacgcagaaggatggagaaaagttttatgtaatacatacttctcaacaatcatcacgttagcagcagcctttgtattaacaagaattggttatgcaaatatctggccattatttggttccgcaaaccagctcttatctgctttagtattagtaacactttgcgtattcttaaaagtaaccggacgaagcaacaaaatgcttttcccaccactgattatcatgctttgtgtaacaggaaccgcattagtagagagaaccatttctctcgtacaggcattttctgctggttccgcaacatttttagtagaaggcttacagctgattatcgctattttactgatgatacttggagtgatcatcgtagtaaattcactccgggcttacttcgcctcaaagaagaattcggaaatttaattcgccagacaggcaagtatagaaacagacgaacaaaataatccatatatgtgactttagtcgcagcgtattgaatactcgcttatatgctcgtatccaacacttgctccgaggccacagatatggattattttgattatatagttctgactgtggctgctgttgtgtcatattggcaaggattaggaataaaatttagtagaatttcaaattgagggatttgtaaatttattatgaggttaaaattttcagggagcattaattattccttaaatcccattcatatctgatttgattcctacggcaagcaaagacagaaagcttggaaggcaatagtttacatctgtggcctgggagcaaggtttgaatgtaagcgtgcccgcgaacattcaaaccgccgcgactaaagtcacagatgtaaactattgccttccaaactttcgtctgtttgatatactgaatcaaatcagctcaccttgacttctttgtgtggagaaattataatcttaaattaagattataagtagaatttaaagcaacatttggagaagaagcttggaggaagagagaagatggatgcagcgaagatgaatcaggcaattcgaattgccaagctatattatgagttacattataaccagttagaaattgcggcacgagagggaattagcaagtcttctgtaagccgtattttaaagaatgcgatggacatggggattatagaagttcgaattaaagattctgttttggcaaatgggaatctggagaatgaactgattgccagatttccgattaaaagggcgattattgtgccagatttggtaggtaattcgcagatattaatgcaggatgtctgtgcggcattagcagaagacctcccacgttatataaaaaatgatagtgtcattggagtaacatggggacatgcacttgcagtattagcccagcagcttccaaagattaagagaagcggggtatctgtgattcagttaactggaggattttccagagcaattttcgaatcgggtgctttggatgtgttgaaaaggtttgtagacagtgttggaggaacaggttatcagattccagcgccggcaatggtggcggaatcttcgattgttgaagctttgaaaaaagatccacagattcatgaaatccttgaaatggcggaagtgtgccagacagcaatttattccgtaggtaacttagaacgtccgtccattgtatatgaaatgggacttattgatgaaaatgattataaagacttcagcagaagaggagcagtaggagactgctgttcccactttataaaacaaaacggggaactatttgataaaaaaatagatgcccgtgttgtaggggcttcccttgaaacgattaaaaagattccaaataagttagttgttgccgtgggaaaagaaaaagagaagattataacagcggcacttcaaggaggactggtagacagtctctatattgatgagccaacagcagaattaatagtaagacataattaatttactatttaattcattagacaaactacagacaaagacacccgagaagagaacccatctagctggtttggagtttgagctgccgattgtgaatgagaagaatgaacctgtcaattttgaagtgatttatcaggcaacagatcgatttattgatacattttcttttttgaatgtgagcagagatgataatgaacatatttatctggcagttgatgacaagacaggagatggtctgtcttatgattgcagttataatacgttagaattttcttttgggaaagaagaagatatgaatgtgctgtacaaaagattttgtcagtattatacttatatacagaaggaactgcgtaaagaggggcatatgctgactggcatgggtattaatccccgttatgcagtgaatcagaatgtaccggtagtaagtgagcggtatcgtatgttatttcatcacctgtctttttataaaaagtatggcaacagtattccatttcattcttatccgaattttggactgttttcgtgtgcaagtcagattcagcttgatgtagaagaagagcaggtagttccaatgctgaatacatttacaaagttagaaccgtttaaggcattgattttagcgaactctttatggggagagaatgcggagattttatgtagcagggataacttttggagaaacagtcttcatggcttgaatcgccataatgttgatatgtataatgttgtatttgatacaacagatgaaattgttcgatacataaagagtatgagcttatactgtgtagaaagagaagggaaatatattaattttccaccagtggtttttagtaaatatttttcctctgatcggataaaaggggagtacttcgatggaaatagatatcgggaaatcacattccatccggagatttccgatttgcaatatttacggtcatttaaatttgaagatctgactttccgtgggacagtagagtttcgaagtgtatgtgagcagccggtaggtgaaattatggcatcgggagcattgcatgctggccttatggaaaatatcggagagctttcggaatttttagagaaagatacttccatctatcataatggatataatgcatctgagttgagaagaacatttcctcaggcctttatatggaagggcggagaaacttttaagtccaggcagacagatggcagaaggaatggagaacggaaaaacactggaggattacatcgaagagtatggaggaatgtaatgctgcatattgaaaatgagtatataagagaacatttattagatggtgcatttggaattgagatggaaagtctgcgtgttgtaggagatggtatgctttcacagactgcacatccttttccgggagatgcacatatcgtcagagacttcagtgaaaaccagaccgaaattaatacaggagtaaatgaaagcatcgaggcggcaattgaagaattaaaaggacataccagaagaattcaggaaaagttaaaggcacttccagagccagaattgctgtggccattttctaatcctccatatattggcggggagaaagatgtgccaattgcacagtttgatgggaaagatgcacataaaacagcctaccgtgaatatctttccgataaatacggacgttataagatgacattttcgggaagtcatgtaaatttttctttttcagaagatttgttaagagcagattttgctctgcagtccgagccggattttatgaaatataagaataaattgtatttggagctggcacagaaaatagctgtatatggctggattttagtggcggttacggcggccagtccgattgtagacagttcttttatggaaaaaggtgtctatgggaaaagtgtttttacaggattaagttctgtaagatgcagtgaacttggttactggaatgaatttccaccgacatttgattacagcgatattgattcttacgtgaattctattgaaaagtatgttaaaaatggcttactaaaagcaccgtcagaactctattatcctattcgtttaaaacctgcaggagaaaataatcttatatctttgaggaagaatggaatcgatcatatcgaacttcgtatgtttgatttaaatcctctcacaggagctggaattgatgcgagagatgtgaagtttgcacagcttttaatggtgtggctcgcaacgatgccatcctggtatgtttccaaaaaggatcaggtaaatgctgtgcagaattttaaaaatgcggcccattacgatttaaagacagtaaaaattgcccgtacggaaaaaagagcgcggtctatcgtacatgaggcattaaaagttatcggatggatgaaagagttttatcaaggcctgaaaatggacgatgttcaacaaatcttagattttgaatatgagaaatttgttgatccagagaagagatatgcatggcaggttcgaaaacaatatcaggaaaactatgtagaaaaaggacttgtattagcgagacaaaaacaaaatatgactgtttagagatatttagatatgactggaatctcagagattttataatcagatacttgcgaaagaaaatcaaaatagctcaaaatggtcataatacaatatatgaggagagaagaaaatcaatgtgtgaattgtttggagtagattctgcaaaaaagataccgttaaatgagttattaagagaatttttttcggatggaacagaacatccccacggttggggtatggcatttttttacggcaatgctgtttctttagaaaagcagccacagtctgctgtgacaagcaattatttaaagcagagacttcgtgctaaaatagagacagacaagatgattgcacatatccgtcttgcgaccaggggaacaatggactatgaaaatacacatccgtttgttatgcgtgataattatgaccgcacctggacgttagcgcataatggaacaatatttgaaagtgaagtacttgagccatttgtagcaacagaagacggagatacggacagcgaacgcattttgtgctatattattgatcaggtaaatgcagcgcaggatgaaaagggagcggcactgacaaaagaagaacgttttgcgcttcttaatcgtattatcctggaaatcgcgccagagaataagctgaatctgcttatttttgacggagagattatgtacattcatactaattataaagacagcctgtaccgttgccgtaaagacaaagcaatcgttatggcaactcgtcctctcgaccgtgataaatggaagaacgtcccaatgaatcagttacttgcctatgaagatgggaagcttatttatacgggtacaaaacatgagtatgaatttgtagacagcgaagagaagatgcatatgctgtttcttgattttgcaaatctttaaaaataacacagaaaaggaagaaatatatgttaaatcaattttcaagaacccagcttttactgggggaagaagcaatggataaattaaaaaattcccgtgtggcagtttttggagtcggcggagttggtggttatgtctgcgaggcattagcgcgaagcggagtcggtacatttgaccttattgatgatgacaaagtgtgtcttacaaacttaaatcgtcagattattgccacaagaaaaacagttggcaaatacaaagtagaagtaatgaaggagcgtattttagacattaatcctgatgcacaggtcaatgtccaccaatgctttttccttccagaaaatgcagatgattttccatttgatgaatatgattatgttgtcgatgcagtcgatactgttaccgcaaaaatcgagattattatgcaggcgcaaaagtacggaactcaggtaatcagtagcatgggagctggcaacaaacttgatccggcagccttccaagtagccgacatttacaaaaccaaaatgtgtccacttgcaaaagtaatgcgtcgcgaactgaaaaagcgaggtgtaaaaaaactgaaagttgtttactccgaagaaaagccaacacgtccaatcgaagatatgtccataagctgcagaacaaattgtatctgccctccgggagcggagcataaatgtacggaacgacgcgatattccgggaagcgtagcttttgtaccatctgtggcagggcttattatcgcaggggaagttgtgaaggatattgctgggaaataggattttgccagagaattttttatatgctcaaagaacgggtgaagcatttaatcactttctaagtactagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctagagcgtgtttgaaaaatcattggggcatttatttaggaaatcaggctggaattgtgggggtttctaaacgttaaaagcacaaagaaatgaagaatatagttttcaaagattgcgtaacaccgtcaaaagctatattgagaaaaataaaggggaatgtgaggtatatccatcaccatttgcggttttttaaataaagatgaaaaaatatatgtggagccagatatcagtgtcatttgtgataaagataaattaaatgacaggggctgtgtaggtgtcccggattttgtaatcgaagttgtttcaaagtctagcaggaagatggattatacaacaaagaatccattatattcggatgtcggtgtaagagaatattggattgttgatcctgaaaaggagcgaacaacgatttactattacgagcaggatgaagcaccgatgataagcctatttattcagacgattcaaagtgggatttatgaaggattggagattaatatatcggaattattgaagtagatagcattctgtaataacaagtggaatgtatagattaggaaaatccaaaatgtagcggttaaaagaaagtttcaaaactaaactaatctttacattccaatatgttattactataaatccatattataaaggaaaataactgtgttgacaatatacttaagattataattaatattgatgtgaaaagaaaaatatttatcctattagattagtgttgtaaaatgcaaagaaaggtgatataatgcaagtacaattttagtgaatggtaaagtatagttatagatgagattttgacataaataaagaagatataaattgtcgaccgataataatgcaaaaatatagggaggttgacaatgcgataaatatgggctgagagcgaaattataataaaaatatggatgtaagatggggagaatagaaagaggtcgacagaaaaagaagaaagactatagatgatataatggtagctggaggacgggaattaatagatacattatggaatgtaaatgcttctgcagataaaattctgcaagttgggtgcaggaattaatagatacattatggaatgtaaataaaaaatcagaagcggaaaagaaaagacaagtaaaagaattaatagatacattatggaatgtaaatcagaaagttgcgttaaaggaatataacgcactggttaaggaattaatagatacattatggaatgtaaatatatttgtaaatctaactaatacttgtcaatgtccagaattaatagatacattatggaatgtaaataaatttgggacgagttttataatgtagaactctatgaattaatagatacattatggaatgtaaataccacctaaaagataagcgatagctccgccaaaaatgaattaatagatacattatggaatgtaaatgataattcatgtaactttttgagtaatgcttttagaattaatagatacattatggaatgtaaatgtatttggaacccagaccatttcctcttgtgattctggaattaatagatacattatggaatgtaaatgcagattggatagaacaattacaacagactggattgaattaatagatacattatggaatgtaaatgtcaaaaaggtagataccgatgagtgggaataccaggaattaatagatacattatggaatgtaaatacacatctaaaactgatttagataaaagtattcagtgaattaatagatacattatggaatgtaaatacatatttcataattaaatcgtgtgaactatcttttgaattaatagatacattatggaatgtaaataaagaatttacggttttcattaatcgttttttatagaattaatagatacattatggaatgtaaatccataaccaccaaaactttcattaattctctctggtgaattaatagatacattatggaatgtaaatagacaacgaggaacagtatcgggcatcctgttaggaattaatagatacattatggaatgtaaatttcacaattagtatgttagattggaaggaggaataaagaattaatagatacattatggaatgtaaattatgatgtagaaaagaaatcttttcacgatgtaagaattaatagatacattatggaatgtaaatgtcatttcgggagtaggagccgcatttagtaccttggaattaatagatacattatggaatgtaaatgaacatttcagaggaaacattggtaggaacgattacagaattaatagatacattatggaatgtaaatgacgcaggttatgttagtaatgttttaaaaattagaattaatagatacattatggaatgtaaattgagcatatcaatacatttcttattccctttcgcagaattaatagatacattatggaatgtaaatcaaagaatttttaagaatcaaaaaactgctgcggagcgaattaatagatacattatggaatgtaaatattgatagttgtcttgattgtggttatcagggtgagaattaatagatacattatggaatgtaaattcatctgtgtgtcagataccagtctggcagatggtgaattaatagatacattatggaatgtaaattaaactccgatattacactcccgatggaaaaattagagaattaatagatacattatggaatgtaaatccatgacacatatcaatatgcaatgatgctacggcagaattaatagatacattatggaatgtaaatagtgaaatacatatccatactgaaaatgcctttggaattaatagatacattatggaatgtaaatcgtttgatgaccttgatactggatgagatcgctgcggaattaatagatacattatggaatgtaaatgaagaagattggaagatcaagtcagcgaccatcacgcgaattaatagatacattatggaatgtaaatgaagtaaaagtggtaaggaataagcggccacaggcgaattaatagatacattatggaatgtaaatgactttggctaaaccactgcctttggacataatatgaattaatagatacattatggaatgtaaatagctgtgctgcgttcatcagtgcagataaaaatgtgaattaatagatacattatggaatgtaaaagatagaatataatagtaaagaataaattattaaagatgtttataatcctttagaaaactaagcgagaattctcggtagttcaattaccgagataaaagtgtttgtttttgtatatagctgaatgctttttttgaaaacaaaaatatgttcgaaaaaatacttactatatagtaaaataatggtatatctatatgtataaaataaagtcagatatattttatcctcttacagcaagaagactccgacctctaaggtgggagatgaattgtgtctgctacctgcttgatagagcatcctgattatagtatagtatctttagtcggataataaaaaattgagatacaataaattgagataataacgcacatttagtattcttactatactatcatcttgtgcttgtgttcaagtatcacaggtgggggttcgaggaaaaggaagtggcatggtggcaaacagagcatataaattcagaatatatcccaatgatgaacagaagagtttgtttgctaagacttttggttgtgtgagaatggtatacaatcattggcttgatagaaagattcgtcagtatgaggagaacaagacaaatgtaacatataccatttgcgcaaaagaaatggctgcaatgaaggaaacggaagaatacagatttttaaaggaaatagacagtatcgcattacaacaatcgctcaggcatcttgatacggcatttcagaactttttcaaacagccgaaaacaggtttcccaaggttcaaatcaaaaaagcggaataaaaacagctattccacggtctgcatcaatgggaacataactctgtctaatggatatttgagattacctaagattggacaaatacggttaaaacaggacaggattattccagatgaatacagactgaaatctgtaacagtaagtcagacaccaagtggaaaatactatgcaagtattctttttgagtatgaagatcaagtacaggaaaaggaactgcaaaagtttttaggtctggatttttccatgcatgaattatatcgtgacagcaacggtaaggaacctgcctatccaaggtattacaggaacgcagagaaaaaattagcgagagaacaacgtaagctttccaaaatgcagaaaggttcaaacaatcgcaataagcagagacttaaggcggcaaaacttcacgaaaaggtttccaatcaacgaaaagactttctgcataagcagtcaagacagatagccaatgcctatgattgcatatgtatagaagatttggatatgaaagcaatgtcacggtcgttgaaatttggaaaatctgtttcggataacggctggggaatgttcacaacatttttgagatacaaactggaggagcagggtaagaaactggtgaaggtggatagattttttgcaagcagccagacctgttctgtttgtggttacaaaaatgcaaaaacgaaaaatcttgcgttaagagagtgggattgtccgcagtgcgggaaccatcatgacagagatgtaaatgcggcggtaaatatcagaaatgagggaatgcggctggtaaatgcatgaccttaacacaatataacacaaccgtgggacacacggggatagctcgcttatgcttagcacggtagtgctatcgaacgagaaccaaacttgccgagatttgccgaggatgggaagccccacctctataggtgggggaggatgtcacacgatagattctcgaatagaacttctgcataaacaagattggtataaatgttgaccgatgatagtgtaaaaatatagggagggccacaatggcacaaataaaaatcttaaagagaaagaagggggaagatgattcaatttaatttagagtttgtcttggaaaaaccagagttaccgttagaattagaccggctgctggtaagtttcttaaaagcgtcgttagagagtgcttcaccaaagatgtttgagcaattatatgataagagaaggtcagtgataaaaccatacactttttcttattatctgccaggggcaaagtttaaggacgagaagatatatttaaggcagaataagttctcgatgtttttttcaaacgcagatatggagcagactatttatttttttaatggatttaagaaaatattacatcagcgttatccgatgaatggtaattcgatggagcttgtacgcattaaaaatgtgaggagaaaggagataaaggatccggagattattgtgaaaatgcagagttctctcatagcaagaagacatgatgtagaagagaacagagatacttattatgtttacgaccatccagaattttctcaggtagtgaaagaaaatgtacagacgctaattgagagattaggagtagatgtctcagtagaaggctttgagattgttccaataaaaggcaagaaaattgttgcaacgatatttggaagaaaggtagatgcgaatattggaatttataaattatcaggaagtccagaacttctgacctttttatatcggacagggatgggaggcagacgttcggaaggacatgggatgtggaagatagtgtattaataggatatttttaattaaaaaagaaaatatctagagcgtgtttgaaaaatcattctcgcaatctgcacgccccaatttgcggtatattttgccttcattcagttgatgtaacccgctacaccgctctcattcaggcaaaatctcccacaaattgtaacgcacatcttacagaaagggggagaaaaagttggacagagtaattattacactcggtgattttctgaagaatgccggaattgtaggtatgaaatacttgttggatatatccgaagcagaagaagattcagattatggtattacatcagatgagcaggggatttggctggatagagactttgcacttcatgcagactggacagatttatattttaatgcctgtgtaaagtattttggcaaaaacacagtatatcagggggtacttgacagaattgagcgttgccttactaaaataagggaagataaatggaatccaggaagagaagaaaaggacgatttaaagtttatcacggaaaagctgctttcgaatagctatcagaacggattcaatattatcaaagagaaggtagagaaccctgaagtttatctggaactgaagaagaataaacttagtgataaatttgaatctgatattttaagaaagcgtttggaagaattacagcaatttttaacacagccgttatgtagagaaacttttattatgaaaagtataatttataattatattaaccgattttgggatggaaaatgtttccttcttcgggcaaatgcaaaaaaggatatgcgggctgtttttgaaaaggatttttcggaaccgtttcataagtatttagaaggtgaacataaaaaagcaaaagatacctgtattgactgtgggaatgggattactggaaaagaaaaggtttctatcgcctttatgaaagaaatggcagatgatttgacaagaaagcgttccgctttctggaattgtcaggtagatgcctttttatgtcctgtatgtgcctttgtctatgcattaagtccattgggatttcaaatgtatgcaaataagttcgtatttatgaatttgaatgaaaacatatcggtattagtggatgtgaacggtaaaaaacgagggaacggtcttaaggaaaaaggagaagaagaaaactatacagtatggtttgcaaggatattgaataaagttctttctgacaaagtaaaagaactcaataatgtgcaggttattttaagaggaacacgcgcagaagataattatatgttcagtattataggcagagatgccctacagattctgaaacaggaaaaggtacagaaagcattgaaatatcttgagcaacacccatatgtaaaactttctaatgaatttgtaaatgttcatgagagcgttgttatgaatattttgcagtatcataaacagtatagtttacttaatcagattttaaaggagtctctggggaatactggagtaataccaacggcatattgggtttttgtagttcaattatgcacaagtattgaaaaaagaatggaagtaaatgtggggagcatttctgaagagttggaacaatcgcagcagggtattgaagaaaaactgtcaaaggctaaggaggggatatttatgagtcgtattaaaatgagggatgcaggctataaattgcgtaaagagattttattagcaaaaaaagcggaaaatgatgaatgtatgaggggaacaatctatcaattactgaatgctttgtctgtgcgaaatgaaggaaaatttatggatattgtaatacggttgtatagttcaacaaaattacctatggcagatggtttcgtttatatgcttggaaataaggagaagttttcagagtatggctattcttttatactgggattaaagggaagttatacagatagtaaggatagtaaatcagaagatacgaaacagtcacaggatgaaagtggggaggaaaattaaatgacaagagatggtttaacatttacaatggtatttttagcagagagtgcaaactatggtgagggaatcggaaatatcacaacattaaagaaaatgacaagaggagatttccagcagtattcttatatttcaagacaggctatgcgatacaatatcgtaaagcagcttaaatgggataatacaccggttgacggcaagagtggtgtagtacagtttgccccatctgcaacaattgaagattatccagaaatcgatttatttggatatatgaaaacgacttccaaagcagatgataaaaagggtggtgcatctacaagaagcgcagtagtgcgattaagcaatgcgatttctttagagccatatcagagtgacttggagtttctcacaaacatgggactggcacagcgtcagaacctcgaaaatggaattgcgcagagtgaaatccatcgttcttattacagctatactatatcgatagatttagatagaattggagtggatgtggaaattgaagtatcacaggaagaaaaagcaagcagagtaaaggagcttttagataccgtacagtatttataccgagatatcagaggaagaagagagaacttaagcccactgtttatcatcggtggaagatataaaagaaagaatccattctttgaaaatattgtgagtgtaaaggcaaataaaattggtgttgccacgttaaaagagattgtggaggattcagaagaattaaaggaatatacttacacaggaatcacatcgggaattttcgataatgaaaaagacgtaaaagaaaaattaaaagcagagtccgtaggaaacgtattcaaacatttgaaagaggaagtggatgcttattatgaaggcaattagagtagaatgttttcagaatcttgtaaattataggaaaccgagcagttttattattaaagaaacttttccgctgccaccatactctacggtactgggcatgattcatgctgcctgtggttttacgacatttcatccgatggaattaagtattcagggaaaaaataaaggaacgatatctgaattatatacaagatattccttttcagcaggggtaaagttcgaagaaggaagacaccaaatttgcgttcatgataaagaggactatggagtatttaaaggaattgctaatgtcgaactgatttgtgaaaataatatgattcttcatattttgccgtctgaagaagattttgatactgtttatcagtcattgttaaatccaccacagtatctttcattgggaagatatgaagatttactagatattaaaaaggtagaaattgttcatttatcatgggaagaagaagttagtgtgcataataatatttatattcctgttgattatgaaaccgaggatggagaacgcatatttgaagatggtgaaggtggcgcaacaatttataatctgacaagagaatacgagataacaaaaaatggtttacgcagatggaagaaagatggtggacgggtaagagcatactattatccggctggcaaggtattagatcagggatatgtggatgattctgaggcagaaagtgctgttgtatttagtaagaacataagatagattttgtgtattgggggaatgaaatatggagttatatgcaaaatcaaaagcgaagcaattgagcatcaaggaagtagaagcattaaaagaaactctggaaagttttttagacagtttagaaggaatactcactcccaaagaagaacagataataattcagcaaattcagaaaatacagaatcaaaaagaagaaaagcagaaaactttgaaagaacatgaagaagatattgtaaaatgtgccgaagcttttttcagaggatatggaaaatattttactgagatagaaaaaatattaattctccaagcttgccgccagcatgactggggaaaggcaaatctcatttttcagtccaaagtatgtcagaaagtacgagataatctgtcggagcctgagaaaaaaatttctcagattccgcatggatttttaagtgcagtatctatttcttataaggaatttcaaaaattatatgaaggattagaaaaagatgattttaaggcttttatgacagcgatttattatcatcatgatagaaaagacgattttattcaggatgatataaaagcatattgccagaaatattatttaaaatatctttcggaatatttgaaagaagagcgggacaaggtatacagcagccagatgagaaaattgcttttccgaaataatatgtcaagcataaagttagatgtgaaaccttctctctggaacaaatatgttttactcaaaggaatgctgaacaaatttgattatacagtaagtgctggttatgaatttgccgaagaaaattcagatctggaagaaaaaaggctggtaaataatatcaataaaaatatgaaagagcaaaaatttgctttaaagccagcacaaaaattcatgcaagaaaatgtaaataaaaatctggtagtcattgccccgactggttcgggaaagacggaagcggcattgttatggcttaatggagagaaaggcttctatactttaccattaaaggtttcggccaatgatatttatcgaagaatcaaggatgattataattataaggatgtagaactgcttcactcagatgcaatgcaaaaatatttagaagaaagtacaaatgcagcagatagtatatatcagagatatgaaaaagccaaattattatctaatccacttacgatatgtaccgtagaccagcttttcaaatttgtatatcgagcattaggaacggaaatttttgcggcaactttaaaatattctaaagtcattcttgatgaagtgcagtcatatgacccacatattatagcaacgattgtaactggactaaaacaaattacagaaatgggaggccgatttgcgattattacagcaacttttcctcatgtcctaaaatatttcatggaaaaatgcggattaatccagggagaacagtatgaatttcgagatttttctaaagaatcagatattatccggcataaagtcaaaataaaatcaggagaaatgaactttgatgaaatacttgaaaaaggccgggataaaaaagtgttagttatctgtaatactgtcaccaaagcgcaggaagtttatgagcagattgagagccagttagaagagaaagacctccatcttttgcattctcgatatgtcaaaaaagaccgcctgcaactggaaaaaatgattaagaatttttctgaaaatgaagaagaatgcggaatttggattacaacacagatagtagaagccagcctggacattgactttgatgtattatataccgaaatgtgtacggtagatagtttgctccagagaatgggacgatgcaatcgaaaagggcgttatattccagaagaaccgaatgtcattgtttatgataatgcgaatggaaagggaacagtttattatgaagatatgtatgatcgttctctcgaaaaactgtatcaatatgaagataaaatatttacagaagagctgaaaacggaatatatcaatgcagtttactgcacagaagaaattaaaaaaacaaagtattatgaagagattgaatactggctagaacatttttcaacaattcatcctatagaatataccaaagaagatgtcgataaaaaatttcgaaatattcatagcataacagtactgccagatacactctatgaagaaaatcaagttctttttgaagagggagtcaatctactcagaaaaccaaatataaacaaagacataaagaatatcattacatctaaatttagcagtctgacactgggacttacttactatcgttataaagataatgggctaaatggaatagatgtcacaacaatcggctctcacggagatgacagaaaaaataattaccctgtaacacaaattcacagaacatcaatgaaatatgattttgacccggatacgggaaggggaaaaggtcttattttaggggagatagatgatgaggcatgtatactgtaatatatgatttatgattgaataatgaggacgaaggtatgacagataaaagaatcacaggtgtcatgatttactattactttgtttgtaaacgaaagctatggtatttctgccacgaaatcaatatggaatcggaaaatgaaaatgtacagttgggaaagcttttggatgaaaaaagttatgaaagggatgagaaacacatcaatattgataatgtgattaacattgactttatcagggaacatcaggagttacatgaaattaagaaaagtaaggcaattgaagaagccggaatctggcaggtaaaatattacctttattatttagaagaacggggagtgaaaaacattaaaggtaaaatagactaccctcttatgaagaaaactttgttagtagaactatccgaacaggaccgtgaaaaattaaaatcaattattgatgaaattgaatctatgaaaaaagaagaatttccaccaaaatttacagaacaaaaaatatgtaaaaaatgtgcatatcatgacttgtgttttatataaaggcagcagggggtacaaatggagcagagcttcaaatatacaaattaggtaaagataatcaaggtgatttgaagagtagaacaaatgaaacaaagcttaaaatatgctttacttatcttctgatgaactgacttttcaggaggggtacgaatgaaacaaagcctatatatttataataatggggatttaaaaagaaaagataatacattgcaatttacaacatatgaaggggacaaaagggacataccgatagaaagaatttcagacatatatatattgtcggaaatgtcatttaacacagcgtttattaactacatttcacagtacggaatcccattacatttctttaactattacaacttctatacaggaagctactatccaaaagaaagcttacttgccggacaacttctcgtaaaacaggtagaacattacacctgctatgatgagcgtctcgttatagcaaaagaatttatcaaggcggctgcagataatatttatagaaatttacgttactataacagcagaggaaaagatgtagctgagtgtatgaaagaagtaaacagtctaagaaaaaaactagaccacacagagtttatcgaagaactaatgggaatagaaggaaatatacgaaaaaactattataaggcatggaacaccattgtaaatcaggaaatacaatttgagaaaagagtgatgcatccaccagacaatatgataaattcgctgatttcttttgtaaactccttgatatatgccaaaacattgagcgagatttaccacacgcagctagacccaacaataagttatcttcatgaacaaggatttcgaagatattctttatgccttgatgtatctgaggtattcaaaccactgattggagacagattaatattttctctattaaataaaaaccagataacagaaaaaagttttacaaaagaactaaactttttacatctaaaaaaggaagcatcccgcctgattgtcacagaatttgaaaaacgaatgaaacagacaatcatgcacaaagaattagggaaaaaagtctcttatcaatatttaattcgattggaagcatataagctcataaaacatttgataggagaaaaagaatacgaagggtttagaatatggtggtaaaatatgtatgtgattttggtatataaaaatttttgtgtcttatagaagaatgatgacagaggtaaaatatgtatgtagttttagtatatgatataagcaaagacgaaaacggacaaaagagatggtcgcatatctttaagatatgtaaaaaatatctatctcatattcaaaactctgtatttgaaggtgagatatccaaagttcaattagtaaaactccaacaggaattaaaagtatacattgattccaatcttgattctgtaattctattcaaaagccgccagcaaaagtggctggataaagaattttggggtaaggaagatgataaaacaagctttattttataaaactgtcgatgcccgacaaggcaaaaaatgaggcacatcaataatagtataagtaaaggatatgtgataatttttattttataatacataacaaattgcgtattgatttgattgacacataataaattatgtattaaaatatgttatgtaaggagggatgagatgaaaagttattcatccagagaagtgattgggatattgaagaaagatggatggtatgaggttgcttgtgttggcgatcatcaccaattcaaacattcaattaaaaagggcagggtaacagttactcatcctaacaaagatattccaatcaaaaccttacgaagtatatcaaagcagtctggagttatgtttccgtaacttctctgcacataacggaggtgttaattatgtcaaaagaccgatattcttatgtagctgttttttcttatgaagaagatggtattagtattgaatttcccgatttacctggatgtcttccatgtgctgagaaagataatacagaggaagctttaaaaaatgctaaagaagctcttgggctgcatatatggggcatggagcaagatggtgaagagattcccgttccaactccgattacatcgattcatttggattctaacgaagttcctgtattgattgaggtatttatgccgcctgttcgtgaaaggattaatagtcgttttgtaaagaaaactttgtctttacctgcatggctggcggccaaagccgatgaagatggtgttaattgttccagaatatttcaacttgctctgatgaattatttacaggtcagtgaagagaataaagcaggaatcaactaatttaatgaaattccgtttggttgatatcggacgggatttctttaggttcataggcggtttaaaatgaaaaatataattctaagttgcagtttgattatattacagtgagtctgctgataagtagagaagtaagaatatacatttaaaaaattaaaagaaatagcatacgcggtgagaaaaataaaattatagaactgtcgatgttcgataaagtaaaaaacaggggacatcgacaatggcataaataaaagatatatgataatttttaaatgagaatataagggaaaaacacagattgagtctaagatcgacagaaataggagtgaaaaagtaggaaaaatgaggaaaattaagtaacgggaattaatagaaacattgtggaatgtaaatatttctttgaaaatgtttaaaaatccacttcctggaattaatagaaacattgtggaatgtaaatctaaatattgttccgattccttttgtaaacaaatcgaattaatagaaacattgtggaatgtaaataaatttactaatgtcaaatttgactccaattcgtgaattaatagaaacattgtggaatgtaaatgatgatacaaatgtaaatgatgtggttaaaattagaattaatagaaacattgtggaatgtaaatattgatggaatggtattaggatataaagatattggaattaatagaaacattgtggaatgtaaataattaacacaaaattcacaaagcattgcaattgcgaattaatagaaacattgtggaatgtaaattgaacttcctccgaacccgggaacccagtcggggacatgaattaatagaaacattgtggaatgtaaatatgtcttgtaattaataaagcggctgtacaaacctgaattaatagatacatattggaatgtagattattatcataattaatatttagcagatgggatatatcaaaaagaaaatatgacaatgattttaaacgggacatgaaattgctaacagtgatattttaagtgaggtgctgaaaggtgatagagtatgagaattatggaaaattagagagtcttgcagaattagaaaatgccatagagatgggattagatattgagtttcttctatatgatacgaggtataatatttcttggagagataacaaaccatttatatgcgaatgtccagaaggagtggctaagttttttgatacctcagaacttttgttacagaggtatgaagtgggtgacaatcctctgaaatctctatggggagatatgaaaatattatctatgtgattaacatgtttggtaaatggaaggcggacgtgttaattttatacctattttaaggagaaattttatagaaatactctggaatacatttgcacaaactccttgcatagtttaaaataggaaacaatattacagaaattacgaaacaaaaattattagattttaaaattgagacaaagaaaaaaatgaaaaaatgtaaaatcacagtcatgcgtaaagcatgctataaagatttaatggaaaaatatgagaatcctatggaacatgcttgtgatatagaagaagggcaagttttcatcgccaatggctggtgtaagccagttggaatgtgcgatagtgcctgggagagtatgtcgccatttgtcatgacattagcatatggaggcaaggacatttacaatggatggatgaaaaatgaaaagtcagcaatgatatcctgcaatgatgggttccgtccagtgagttttcttattgaagctttggaagaagaagctgattagtgcactggattattgacagaaagtttcatattaattgtgaattggattatctactataaataagcaaatatcaaaaagtgcataaaatttataaacgcttgtgtatatcacatatactgtaagttctgctgatattattgatgtctgtacataacagatatgcttgtacaattttttatttactcatttatagttatatattaataaaaatataaaagtcatataagaaagaagaaataaaatgcaaaaaacttacaccgtaatagaaatttatgaagcagattttggctgtgaagagcggccggaagggcaggaaacaatggtaggcattcgtttgaaggcagaagatggagaagaaattcataggcaggaagcggatgctgaactatatgccaagaatatcaatgaaggcgataaagttatttttattgaaggaagaattgaaaagcaatgttgatttatttgttgattattaatataatagcgtttattatgtatggaatagataaatggaaggcacacagaaaacagtggagaatttcggagaaaatgttactttttcttgcggtaatcggtggaagtgcaggtgctttggcgggaatgtatatctttcatcataagacattgcataaaaagtttacgattggagtgccgcttattctggtgatacaggtaatgatttttatctgtattatggagaatttttacagataggacggggaaatgattacagagtataaattagaggatgcaggccgggaaatgctgattacgataaagcgttcttccagaaagacacttggtcttgaagttcgggaaaatggggaaatatttgcccggattccagagaagttatcagacagaagtttgaaatctttcattgaaaaggaaagggactggattattaagaagagtgagctggtaaaatgggagagagaacatcgacagacaaccaatgcaacacctgttcaggaactgacttcagaagaaattgagaatatttcacagaaaattgtggatagagttcgattttatcagaagaaaatgggtgtaacagtgggccgtgttgcaattagaaatcagaaaacccggtggggaagctgtagtgcaaaaggcaatttaaattttaattatcagatttattatcttccagatgaattattagattatgtcgttgtccatgaactggcgcacagacggcacatgaatcattcggatgaattttggagagaagttgaaaaatattttccaatgtaccgtcagtgcagaaaaagattaaaagaaatacgattgattaattgaggaatacaatgtttgatgttggtgatagaataatcggactggaattgccggacactttttataaattagcggaattactggagcaggatcaatttgaactgctcttatcaaaaaatagaataaaagatatgcatagaaaacaggacatttcccttgtatatttaatgaatgatgctgtggaaagttttcttgttttccataatgctacaataacaggacaatacaaaagtgaatacgagggagggctactggctgttcttgataaaaaagaagaggagtatgttctggtcgtgcatcagggagacagcgtaattacactgttttttgaagacttattgcagcaaaataatttatataattacggagatatcggacatttctgggtaaaaggatacgaatatctccgtttgttagaatatcgcctggcaattcttcgtgataaatgcgattatctggatatagattgtagcacgccagaagagcgaaaactggcagcattagtagaatttccaccactgaattattgctgttatccagcggtgccggaaaaatatatcgttccaagacaaaatccgtggcagccttcggatgaagcaatcgatttgatgatagaaatagcaaaagaagcaggagataaattatttgtacatattttatcttattatcagaagaataattccaaacttatgtccagatttattgccagaatgctccacaggaaaaaacatataaaaatagtcagaatactcacgaaaaaactccaaaaagcagcctcaatctatccagtacgttctttcggaatagaaaatgatatacaaatacaaaaatgtctggaaaaagcaaaacaaaaaaaacaggagttaaaggaaaaaggaataaaggcagatatcataagagaagaaccatttgtagaggctcaggattccgtacaatataaaatttacctaatgaagtggaaacaacaaagaggtaactacactacagaaatagaggagattactatttaattcgttagacaaacagacacccgggaagagaaccgataccctatatttgtgactttagtcgcggcggtttaaatgctcgctttactcgctcgcatctaagccttgctccgaggctacaaatatagggtatcggttctcttcccgggctgtctttggatggattttgtttgaattaaatagtggttgcggagatttgggggagagggcagaaattttctgcttcctctcagaatattgtagatagatatttttatctaaattgaaacagtaaatattttagaagaacgaagatccactacttactctgaaattattgaaatattccgatgatagtcactaaaaagatatattttctttttatgagttatatgtacctacctatggttattccataagaattagataaagaactagattttaaccaagcttggcatgattatcttatattatacacaatatttataaaattaaatttaaaatgccgatttcttcattttactattacatacaggcaggtcaaatcatccccctccattccccgtcattctcgagtaagcagaatacatcagcttctgtcccccaatcccttccacctgtttaattcattttctccagccacagcacagaagccagtgaacttcataagccatatttgtggtctcggagcaagtgttggatgcgagcgcgtggagcgaacattcaacgcgccgcgactaaaagcacaaatatggcttatgaagttcactggcttcgtctgttgtttacttaatgaattaaatagtaaaaaatattgtaacctttttagttttcatttgttatatgtatgaaagaagtcgaaaagtatcgaggaaagggagtgagaatctggataagcatttgttagaagcgttatatcaccgttattataaggagctatacatttttgtatattctctttgtggaagtgagacagtaaccgatgatattttgcaggatacatttttaaaagctctgctggcattgaaagattctcacactaatatgcgggcatggctttatatggtagcccggaatctttattataattattataataggcagaagaatttgttttccatagaaacagaagaagtggatagaagaaattcaagggagaagattatttctggtgaaggagaagcctttattcagaatgatattttggaagagatattacataaagaagaaaaaaagagggtgtgggatgctgtgaaccgcctgaaaggacagaagaaggaagtaatactattacagtattttggagatttttcgcaaaaagagattgcagcaatgctaaaaataactccaggtaatgtgaaggttctttcttatcgtgcaaagaaggaattaaaagaatatttaacgaaggaggaaggaagatgacataccgcgaattactggaattatataagaccggagaattagaattagaacagagaaaaaaggtagagaaagatattgagaggcaggaagcgataagtgattacctttatgagcaggaagatattccagaacttaatgatatttttgaggaaaaagcagccgctgagaagaataataagaggaacgatgatatagaggatatagatacaaaatttatagagatggtcaaccgttcaatcagacgtgcgtttcgcagaatggggctgactattttagcggcggcatgtgtgctgattttatttgtacaattctgccttccaacgattgtatcatgtttttattataatccagcgaagaatataggagacaaagattacgcgataagtaagatgagtcgtgatatggcggtatattctgaagtttttctaccagggaaaaggagaggttctgtgcaggtggaagcaaaaggatatgggaattataatatcacagtcaatcagacttccagttttacaggtagcctgacagatgtatcaggagaaatcacacggggagagctaagatactatgataacaatatttttaaaaagccagctacaaatgtttttgtatatggaagcattgctggaaaggaagaaaatacggtagaagagaatttaaaatatacaagaaaatactttgatgtgaaagacgatgaagaaatcaatctatgtgcggcaggatctaaggaagagtctctcaaaacattacaggaattagatgaaagaaaaatgtatataggctatgtttctttagataaaattatgtcatatgccgactttaagaaatatgtggataagcaggatttagcagaagtatggtgtgcggtgcaggtagcagaactggagaaggaagaagaaggagtagtaaactttcagtcgaatataccgaatattggatttgtatgcaatccttcttataacacagcaattaagtgggatgagaaaaagtatccaaaccttttaccagggtgtgaaacacaagatatgggtaatgaggacgaatgggatgacccggaagaaaaccttaaaagtgaaagcaatgccagacagcattttgtcagtttacttaactatctttccaatcagaagaagttcctcgctatgatggagaaagataacagtaattatacaaccaaagaattaaaagagatggtatcctacatcaagaagaatgggataaaagtgtatggatttactacaatcgcagataaagagacattattaaaactcagcaaacaaagcgaagtatacgaaatatacacagaagaagtgagatgactatttaattcagtaaaacggcagacgcccgcgacgagaaccaatactctatatttgtggtctcggagcaagtgttggatgtgagtgcacaagcgaacattcaacacgccgcgactaaaatcacaaatatggctgatggggttcactggattcatctgcatctgcctaatgaatgaaacagcaattcacatttatttcacataatgttcgttgacaactttagctttgaaagtttacaatagtccaatagacaatagtaactgattgtaagaattttcagaaagtattattgtctgtaagtatacagaaaggaagtaacagacagttatgaaagaagtaaagacaccgagaaagccgtttattttttattatattattgtgcttctcgtactcatgctggtcaatatgtttgttatgccgatgattagagaggcgagcattaagaaggttgattataatgagtttatgaatatgacattaaataaacagattaaaaaagtagagattgatgattcacagattacatttaccgatcagaatggaaccgtttataagacgtccaagatggatggtgactggggattaacggagagattatatcgttcaggagctgaatttacgacacaggttcaggaacagatgtctccaatattatccttcctgttatcctggattatcccaattgtgttgttctccgcattaggatattatgcgcagaagaagatgatgaacaagatgtccggcggtggtccgaatatgatgtttggtatgggtaagagtaatgccaaagtctatgtaccgtccgaggaaggtatccgttttagtgacgtagcgggtgaagatgaggcgaaggagaacttagctgaaatcgtagattatctgcatcagccatcaaagtattcagagattggtgcttccatgccgaagggagttcttttagtaggccctccgggaacaggtaagacgatgcttgccaaagccgtagctggtgaagcgaatgtaccattcttttctatctctggttctgaatttgtagagatgtttgttggtatgggtgcttcaaaagtaagagatttatttaagcaggcgaaggaaaaagctccatgtatcgtatttatcgacgagattgatgctattggtaagaagagagatggacatatcggcggtaatgacgagcgagagcagactctcaaccagcttcttacagagatggatggctttgaaggtaataatggcgttatcattttagcggcaacaaaccgtccagaatctcttgatccggcattaaccagaccgggacgatttgaccgccgtgtaccagtagaacttccagatttagtaggaagagaagccattttaagagtacacagtaaaaagactcgtcttgctgataatgtagatttgcatgccattgcccgtatggccgcaggcgcttctggcgcagaacttgctaacattattaatgagggtgccttaagagcagtaaggaatggcagaagaatagtaacacaggcggatcttgaagaaagtgtagaagtagtaatcgcaggatatcagaagaagaatgctgtcctttcaccaaaagagaagatgacagttgcttaccatgagattggtcatgctttagttgctgctaagcagacaaattctgcaccagtacagaagattacgattattccacgaacttctggtgcgttaggatacacgatgcaggtagaacagcaggataaatatcttatgacgaaggaagaaatccagaataagattgcaacactcacaggtggacgtgcagcagaagaaattgtgacaggaacaataagtacaggagcttctaacgatattgaacaggcaacaaagcttgcaagagcgatgattacccgttacggtatgacagacgaattcgacatggttgcaatggaaactgtcaataatcagtatctcggtggagatgcttcccttgcatgttctgcagacacacagaagaagattgatgagaaggttgtagaagttgtaaaagcccagcataagaaagcattagatatcttgaatgaaaacaaagataagcttcatgaactggcgaacttcctctatgagaaagaaacgattactggtgaagaatttatgcggattctggaatcctaattaaatactattaattattaactataaatgagggaatttaaaatattgcacaactatgtccgcattataaagacatactttacttgactggtctgaatgtgtttagactacaaacaagaagcgtcagcttcagataaataaaaactatatgaaaagtcggaatgtgcttagactacaaacaagaagtacctatttttgtgtatttttctgtatttgctcacttacagttattaaaaataaaaaagagaaatctatcaacgacgtaatattatttgggagaaggtatgtttgatataccttttcttactttgatatatcgtatgatggagttctctttttttatctccattgtaagaaagattcctagagcatttttcaaacacgctctagagtacattaaatttataaaataataatgattattaatattgaaaaagcttgcaagaatagacaggacaagatataatcttaatagttacaattacttttaaaaattcaagaatgccccgacattcttgctgcgagatgcgtgtcatgcaatgcatgacatacttcttctgcgcatctctgcaatcctgccggaggctatatcagatggaggattgactcccccactgatattgatttgtagcttgcaacctacagaggcgggagtcatctcacatctgatataaatttacactcagaagagagatataatttgcgattgataaaatggaggaatactatgcgaaaaaaagaacgagcagcgattgtaatagagcgtttaaaaaaagaatatccaggagcagactgtacattagattacaatgaggcgtggaagcttcttgtcagcgtgcgccttgcagcacaatgtacagatgagcgagtaaacattattgtcaaagatctgtttgcaaaatacccaggtgtgaacgaacttgcagaagcagagccagaagatattgaagcgattgtacgcccatgtggacttggaaaaagcaaagcaagagatatcagtaaatgtatgcgtatgctgcgggatgaattcggctcaaaggtaccggataacttcgaggatctcttaaaacttccgggagtaggaagaaaaagtgcaaacctcattatgggggatgtctttggcaaacctgcgattgtaacagacacacattgcatccgtctctgtaatcgaatcggtcttgtcgataatgagaaaaatccgaaaaaggtggagatggctttgtggaaaattataccgccagaagaaggaagcgatttttgccaccgtttagtgtatcacggcagagaagtttgtaccgccagaacaaccccttattgtgaaaaatgctgtcttgctgacgtttgtaagtcttacgcttcttatatgaaagaaaaaaatcagtgaaaaggaattgtcgaaactaaaattttgtagtagaataatttcaaccgagccagtctttacaaagatttttacaaagaataaggctatggattaaggtaaaactgaaacttatcacattggaaaaaaggatggacaagatgaaagaatttaaaccaatcaaagaaggaaaagtccgcgaagtatacgataacggggacagcttaattatcgctgcaacagacagaatttcagcatttgatgtaattttgaaaaatgaagtgaaagacaaaggtgctattttaacacagatgtccaagttctggttcaatcttacagagaataccgtaccaaaccatatgatttcaacagatgtgaaagatatgccggaatttttccagaacgaaaagtatgccggacgcagcatgatgtgcaagaagcttgagatgttcccagtcgaatgtatcgttcgtggttacatcacaggaagtggctgggcaagctaccaggagaacggaaccgtttgcggtatcaagcttccagaaggattacaggaatctgaaaaattacctgaaccaatttacactccttccacaaaagctgatttaggagaccatgacgagaacgtatcctatgataagacagtagaaatccttgaaaagctttatccaggaaaaggtaattattatgctaatatcttaaaagagtatactatttctctctacaagaaatgtgcagaatacgcatgggaaaagggaatcatcatcgcagataccaagtttgaattcggtcttgacgagcagggcagagttgtgatcggtgatgagatgctcacaccagacagctcccgtttctggccaagagaaggatatgaagcaggtaagggacagccttcctacgataaacagtttgtaagagattggttaaaacagaacccagacagcgattatgatcttccagaagaagtaatcgataagacagttgcaaaatataaagaagcatatgagcagttaacaggagaaccatttgaggcttaatctattgtaaatctgtaaagtatgttttagcagagaaagacgatacgtttccacgaaagtgtgggggtatcgtctttttttgtatcatctttcgatatattttgacctataaattagaatctattataatttataataactagggtttataatagctaaagtacgtttgaaaaatcaaaaagtaatttgtagtatattttgttttcttttgatagcagttagaatgctatgttactctcatttagatgaaatattccatgaattgtaacatgcattttgaagaatacatagaatacatttttcaaatataatataaaactttataatttcagataaaagataggaatgaataacatatatgagaaaaaagcagcttccaaagagaatagaaattttaagaaaagcctttgagaataaatggagtttagaggccgtgaataaagaattagaagataatctttgtgagcggctgtatgcaagaaatatatatgaagcaggattgatatatgctttttgcttagggtttgattatgaaaactggaaacaattgtataccgcatatgaagaggaacgaaaagatgccagagactatatacaaagccccgaaaaaaatataattgctacatataaaaaagaacaaaaagatacgaaagaatgtattcaaagtcttgaacaaaatatggttaccacatatgagaaaaaaagagtgccatcttatagcggaatatggtcaggaaaaataacgttaaaacaaatatatgaatatattatgtataattcaaaggagagctttcagacaggaacagtggcagaagagttagaagaaaagctatggaaagagcaggagaatactctgccagacaaaacttcaataggctttttggataaaaagaagaattttatagctttcatgaatgagaatcagaaacaattctctgaagtgagagagaaagcgagatactatttttgcaaatacctgtatttttatatagaggaacgttgtgagaattattatgataaatgcagaaccgaagagaccgaagaaaagatttatggggagagcctttttttagaatattgtattcaagcggaaaagaatgcattaaatcagcttacaatgttaaaattacttactcctttaaaaaatgaagcgaaaaaagcgaaagtgtcactatctttagagcaaagaaaagaatatttacggaatgcagcgttatcatttcgtggcatttttaatgaatttaattatttttattttggctttgtttcactgggatgggtggaaatgttatttgaattttatgggccactgaaagattggagcgaagaggaaaaaataaggattgcctgttctttaggctattgtaagaagaacccatcagatgaagaaaaagagaaagcatttttgcaattagaaagattaagtaaaaaacaagaaaatacagagaaacagcttgatgaaaaatatgcgattggtatggaacgggcaggatatcaaagtggaagaagcggagaaacatattttagagattttattacgggaagaagagatatcaacagggatacgttgctggcctttctggtgtttgttcaagctgaaacaaaactagatctgaaagacaagctcactatcgcaaggattaacagaattctatataattgcgggtttgcacaacttaggccagatcgggaatttgatgaatttattcggaaatatctaacgggagaggcgaaagaagaagttttatatgaggcggcagagagggctgcacttaagagcgaagatttctatttatataagttgtatcaacaggcaaaaagctgccaaaaggaattagaaggaaagttgatttagaaaagaatttgcgaatacataagggataaaggaagaaatatggaaaaggaaaactggcttttagaggaaacgctacttcatgaaaaataccagataaaaaaagtattaggacagggcggatttggaattacctatcttgcatatgatcagaccttgcagcaaaatgtggcgataaaagaatattttccagtaaagattgtgaggagacttggaaatactttaagaaaaggacagggagaatatgaattatcagcaacagctatggtttatccacaaaatggtcaggaagaaaaatatttaaatggaatgcaaaacttccttgaagaagcacaggtgctttttggaaagtttgatgtagaaggactggcagccgttaaagattattttgaagaaaatggtacggcgtatatagttatggagtacctttccggaccgacacttcaagagtatgagaaggaacataaaggaaaaattagtgagaagcaggctgagatattactagaaccagttataaatgcacttgcgtatattcacagcattggcattgtacattgtgatatcagtccggataatttgatttttaataaggaaggacaactcaaattaattgactttggagccgcgaaaaataagaaaaaagaaaaagaagaacaatattgtaagggaggatatactgcaccagagcaatatttagagaaagaattcgttggtccgtggagcgatgtatattctttgtgcgctgtctggtatgaaatgcttacaggaataaaagtgccaccagcagtagaacggttacaaaaagaccgattaaaaaacatgacgatggcatctgaagtgtcagagcaaacgaacaatattctaaaaaaagggctttctctagaaatacaaaagcgatatttttcagtgctcaatctttctagtgatataaagagtaatatggaaagtaaagaagaaataacaaaacagtatatgaaagacacccggttcgtttggggaacgctctggcttcagattacaacagatattaatgaaagaaatatttctcaggaaaagaaatggatatcaaggagaaaaagttttggggcagagaggatttggagtaacctatcttgcctatgatgaggaactttgccaggaagtagtactaaaaaagtatcgttgggaacatggaagtttggataacgaagtaataaataaaagagattactacaaaaagcaaagaaaagcatttttaaatgaggcgagaatcttgtcatccctttttgatattaaagaagtagtcaaagtacttgattattttgaagaaagaagaacatcatcgccatataagaaagcaaccacaggaaaattaacaaatggagatgctatttactacggtgatattttacaggtaacttatagcacattaactaactggacaatagacagtcatggaaaagaaaaaataacggttacaggtaatgtgacatctgctgatatttatatgacagtatggagtgattggagtgagtggcctgatgatgctgatactgaatcaaatacagttaaagtagaaagtaaatcacaatatcgttattcagataaagctacaacaaccagtacaaatgcatcattgccaggctggatacagacaggttctactacatcgtatggtggttggggttcatggagtgtttggcagactaatgctattggtggaagtgatactcgtcaggttgaaacagcaaccgtatatccatactattatttctattgtaaaagctgtggaagaggttctaggtacccgtattatggaagtacatgtgcatattgtaattcctcaagttatgtaaccttagatacaggaacagtagattggtttaccaattcatggtcaagttctacacgatggggaagtaccagtaaatattatcaatatatatacgattatcatgctggtgccaatgccatttattggaattggacagatggaaatgcacagacaggatatagatatagggatagatccaaaacaataacctattcctattataagtggaatgactggtcatcatggagcgatacagcttactcttctaatggtaatagaaaggtagatacgaagacagtttatcgtattaagaaaaaatattaatattaaaaaacttataaaggtacatgtttatgatatatagaaaggaaaaagatatatgaaaaaaatatatacattaataagttgccttgtgcttgccataatggcattagggatgaatgtaaatgcatctacaggaaggacaataatttcagtagataaagtagtagctggagaagaatctagtgtaagggttccagttaagattatgaataatgaaggtttagtaggtgcaacaattactatagaatatgattaggcgctaactctgcagagtatagatagtggagatgcattttcttcacttactatgacaaaacctggagaacttacagaaaaaaagattaatattgtatgggatggaatggaagaggatagctcaaatggagtaattgctatattgaatttcagcaaacctaaaaaagctggatcttatgatgttaaaatatcttatgaagatggcggcataatagatggaaatttacaacctgttgaagtaactatgtataatggatcaattactgtaaaaggattttctgaaggagaaaaagatagctgtacggtaaatggacataaaggaggcaaagcaacctgcatcaagaaagcagtatgctccgtctgtagaaaagaatatggagaagtagacccaacaaaccacgaaggggaaacagaactccgaaatgtcaagaaagcaacatgtacagaagatggaaatactggagatacttactgcaagtcttgtggaacaaagataaaagatggaaaggtaattaaagcattaggtcataagtttacaaaatatgtatcagataataatgcgacaactactaaagatggaatcaagacagcaagatgtgataatggatgtggaactaaaaatactgttgtggacaagggaagcaaaaagactaatccatcacagagtcctaaaataaaaattggacagaaattgcagaattcagttggagtgagatgtgctattacaggaaaaaatacagcagaatgtatagggtatgtaggcaaaaagaattcagtaactattcccccttcgttaaagtatatgggagtaacatatcaaattacttcgattaaaacgaaagcatttagtggaaataaaaatttaagaagtattgttatcccatctagcataagaacgataggtagtcaggcattctttaattgtaaaaacttaaggaatattacaataaaaacaccatatctttctaagaaaacagtaggcgcaaaagcatttaaaggaatccacgccaaagcaaaaatcaaagtttcaaagaagcagaagaaagcatatcagaaactgttaaaagccaaaggagctggaaaaaaggtaaccatcaagtaaaaaatataaaaagataaggaagaagtcaggaattttctggcttcttgctgtatttagaaagcatactaattaaatgttggaaaattttgcaacaaagaaaactcaattcctcttaccaaaagtgcccaaaaatgaaccatctagccctaaagtattgaattaaatcccaataaagctataataaaaataagcagctattcagaaagtcccagcttattaaactataaagtattatgcttttttagagtgtattttatcagataaaatcagacaggaggcacaccatgatacaaaccgaaccccatcatcttaggatgggcaccagactaaataacagatatcttatacaaggagttcttggagaaggaggctttggcattacttacgttggcatggacgaggtactgtgtcagaaggtagccgtcaaagaattctttccaaggggagcgattacaagaaataatcaacagaccaatgaggtagtatccgtttacggaacgaaagccgcgaatttccatcagggagaggagaagttccttcaggaggcccggacgcttgcacagtttaacaatgtagccggagttgtgcgggtgcaggatttcttccgggaaaatggaacggcatatattgtgatggagtatttggagggaattactttaaagcagtatttgcagacgtatggaccgattagtgtcgaagagatgcagaatatatttgctcctatattggaggcgttagataagattcaccaaaatggagtaattcacagggatattagcccggacaatattatgtgtctgccagaaggcgaagcgaagctgatggactttggagcggcgagggattatacggattatagtgaggaaggcttgtctgtcattttaaagatgggatttgccccgattgagcaatacgattctcatggaaaacaggggccgtggacggatatttatgcactgggagcgacaatgtaccaatgccttacaggaagaaagccggatgatgcaacgaaaagaagcttggaggacacactggttagtccgtcaatgcttggcgtacgcattgccccgcctgtagaatatgccattatgagagctttgcagattcggcctgcagaccgctatcggaatctcggggaattttgcgaaaatttatatagcgtggtatctgacaatactgtatctgttaatatgaatacatttacccagccagcagggagttatgactggggaagtccttcgggaacgtccagtcagagcaggcaacaaggatatccggatgtgccgccatacactccgccgcagccaccggtaaagacaaagaattctaccccgcttatcgtagccctttgttgtacattaactgccgtgattatgatcgggataggcgttgtattatttacaaattcaaagaatagccagacggccggaaatacagcgagagcagaatcggggaaagaatcggaaaaagtggcagaaaatactactgcggcaacacagagtacaacagaaagtaaatcacaagatacgcagcaaagtaaaaccgagcagcaggcggctgcgacacaggcagcgagcacaacagaagatactgtggatactcaggctgtcggagcggatggcaatgaggaaatatttgaagataccgatgcttctgcggattacagcgaatgtctcagccttgataattatacatacttggaaagtcctgatggagattatacattctattatccacaaaatgtttataattatgcatattatgacggagacagttgtatttttacctctgatgatgaaaatgacacggtgaagtttatccgtaaagataatacatcaggaagcccggcacagggaatggaaaatctgtataattcctatacgaatttgtctcaaaaagaaaagattttattccgagaggaaacggacgaacgtggatttgcccgaggcgtattaagtggaatcacagacaaccagaatgtatatgcatctatcgcagcaaatgatgactatgtatatatcatggaggtatgcaccagttttcagcacgattctacgaaatcaacgtgggtagaatattatatagactgtatgtatcggtattgtagtttcagcaggagagtcggtgatccgagaagctatgaggagtatatggaagatcagtaagcggaattgacgatgaagcggcataattataactttataaaaaagaacatgatagtaaaaaagtgtatttggaggaaatatgaaaaagaaaagactgataatagcagtagtaatcatctgctgtgtaatattatacatatggcaaacaaataaaattcacaatacccctaaaaaggatactgcggtatcaacagaaagcaatgcaacgacgcagcaggcagaaacaacaactcaggtaacaacacaaacatcaacagaaacaacgatggagtccgataccgaagaatactttgaggaagataccgaagaagaagcacagctaaaaaagacaatagctgaacttatgaaagaagaaaaaaacacgactccagaaggtattcaaaccgccgcgactaaagtcacaaatataggttatttcattctctgagagctgtctccctgcctgcggcaatcagaatttactgactttttcggactattattctaatttgtttcctgctataatagagtctcgaaatgcagatatatgtgagatgagagaggtggtatcgcatgagatgcaaattttgtggaacaacgctgccggatcatgcaaagttttgtccaggctgcggaaaagagatagataatgatagggaacgacacgagagcagagaagccagcaacataccagaagatgcgtattatactaatacaaacaaaaagaattctaaaagaaaaagaagacataaaaaaatatctgtgagattcattattgtctatttgatcgttgttttgacaggaggtttttgtctttacaggatgggatttcctgagaaagttgtggagatgttaagtaagcagtcttcggtaccagattcgaagaaagagatttcgcagaagagcgataagaagaaaaataatgagaaaaagacagggaaggcaacaacagaaaagaaaaaagataagaataaaaataaaaaaactttagaatccacagaaagcacactcgcttatacagataattccagtatgaatgtaggtgcgtgtcttagtccggaggattataatacagtgactgcgaaggatgatagctttagttttgcttatccaaagtatttatttaatcatagtgaggtgaatgaggaaggaacttcctatacattttcttataaaggaaactctgtttctgattcaaatgaggcagaacttagtgtatatacacaagaaaatgagggcgatcctttacagaatgcaagggagctttatcaaaatttttcttcggaagtttataagaagtattttaagatgtatccatcaagagtagacagctcgggtatggcaaggaccctgattggcgcttctgccgattcctcagagaaaacaggggtatatattatagcagcaaatgacgggaaaagggattatattttgaagtttacttatccagaccctgatatgacgaatgattataatgagatagattatgtggtcgattgtgtgtaccgtttttgttcttttagcggtggaacgtatcagccacggtcctaccagcagtttttagatgataacatgggaagcaaaaaatagtggtaaattaaagttttgaaataaggctgcagcaatcccattagctttagttaatggatagtttaaagtaaaagctaagaaagtaagagataaattatagcaggacaacaggaaaatgacagtagagaaattattgttgtaattatgaattttctcttataaatgagtggcgaaaaaatgaatagcttggtataatgagataagaatgcatgttctcattatttaagttaggaagtgaaaagatgaaggtttttaagacgatttttctttgtgtggtgcttatttttgctctggctggctgcggaaatagccatgcagaggcagataagacggtaaaacaggggagtggacagaagacagatggagcagttaatgcttcagaggaatcaacgaaaggggcagccgaatctgcaacggaaggtgtgcaggtgaaggagagcacagcgcaggagtcagcaactgagtcggaacttgactcagatgcaagccatagagctgattatgttattgtgattgatgctggacatcaggctcatggaaattatgaagaagaaccggtgggaccgggggcttctgagacgaagccgaaggtagcttcagggacaacgggggtatctacaggagtagaagaatatgagctgaaccttgaagttgctgtcaagctgcaggcagagctggaagaccgcggatatcaggtgattatgattcgagataagaatgatgttgatatttcaaattctgaacgggctaaagttgcgaatgataataatgcagatgcatttttaaggattcatgcgaatggttcagataacagcacagatgcagggatgatgacgatctgccagacagcagagaatccatataatggcgagctgcatgaaaaaagttatgccttatcggagaagatattagattctatggttgaggcaacaggagcaaacagggaacgtgtctgggagacggatacgatgagcggcattaactgggcaaaggtgcctactacgattatagagatgggttatatgtcgaatccggaagaagatgagaagcttaatagcgatgattatcaggatgagattgtccagggaatagcagatggtcttgaccagtattttaatataggtggaacagaggactaaagtcagataacatcattaatatgtatgaatacacatggaaatacacatgattttgttgtggacagggtatcgggcatttttttaatgcactctggaaataagagaaataatgcatgaaaggataagagaatgaaggataagtcgataaagtcaacgatgaagagctggattatgttatcggaaaaagaactggatgatacgcaggtatatatgcaggaacaggagcagcaagaccagcaggaaaaggataacagtttttccgaagcggaaagcggcagcggcaatgtcgggtcagcgaagtatgagtcacaggtgagtgatgccggtacagagacattttcagatgcagagaacggttttgaaagaaagttaagccgggaagagcaggttgatcagctgataaaggaagctggagaggaagtagtagatccagaagtggactctgttccaagaaagagaagaaagagacaccagaataagaagggaaaatttgaaaagggagaagcaagagaatcaatagaatcagaagaaaggtttgtatcagaaagtacggatgaatcgatgtccgatacgacaagggagaaggaatcaatggcatcagaagtggagaatgcagcagaattgataaaggacaatggaaataaatccgataaaagcagcggaatcagtaagatgcttgtcggcggagttggagttcttctcgttcttattattgcaggacttggttatcagacccagtctttgcaaaagcagaaccagaagttaaagacagaaatcagcactcttaaaaaagagaagaagcaggcagaacaggcttcggaagaacaggcattacagacaaagaatgaggacggtgttgtagagaatacagataagatgtttgcttctgttggtgtcggtgataaagaatataaactactcgctaaagtatctgactttacaaaagacggatggaagttagaagcacttagaaatgaaaatgccaccctcgtaccaggcggtaaacttgaaaaggatgcatttcttacgaataaagatggcaggaaaatcggtgttattatccgtaatttaagcgataagaaccagaaagtaagtgactgtattgtcacaaagctttcttttagtaaggaaatgtttgacggacagatcacacttccaggcagcctgggttttgacagtacagaaaaagaattaaaggccgccggatttaagaaagatgcagatggaatatatacttacacaagcaagaagataaaggacgatacaatcaaagctgcaatggcagatggagaatctgtatcagagtttactttagagcgcgccgtggatgaaagtagtacaagtacaggcaatgcagctgcgaacacgagtgccagcacagcagcaggcagtgccaccacaacagccagtgattcgagtagtgcggagcaaaacagtgtcacagccgatacaacattaactaataattctaatagcgcatcagattctgcagaagaatagaaagtaaagaaacaacagaataatatgcaataaaaaatagcagtcagaaagagagaaacacttaatttctggctgctgttttttgaaattaggtttggtatattatttttatcatttataagttttatcaagcgctgcgtaatcatgagataatttagctatttgggattaagtataaagttttatcgtgcattatataattatgagttgtcagattattttttttaataataggctcttaaatgtcaattattttacaaaatgcagaaataatatttttatcactttaaataattaaaaaattaataattatgcaaaaaacattgacgaatctttcaaatagtattattatatagagaaaagaccgcaaaaaatgaataaaaatgcaaaaggtcatggtgattttttcatttttaagaaggttttgtgggatttaattgaatcagaggagaaagaaagatgaagaaactaatgttaacaatgctttctgttgtaggtatgatgctctttgtagcattgccagcgaaagcatgtacatcctactatgtaggtaaggattgtacaaaagatggaacaacaatgtatggccgtacagaggactattctccaaaaaaggataaggtttataaggttattcagccgaaaaaggttgggaagaatgcgacttttaaagatgagactggtgcaacaacatttcaggctccaattaaagtagagacaacgtatcgttacacaatctgccatgacagtgaaggggcagaagacggatatttcggtgaatttggaaccaatacaaaaggtgtttctatgtctgctactacatctgcatctgtagccaagacggttggaaagtttgatccatatatagatgcatatgaatctaaagttggcggaattacagaagaaaatcttgcagattatgtactttgccaggcttcttctgcaagagaaggtgtagaactccttgcagatgttattgatacagttggtgctggtgaaggtgatggccttttcatcgcagaccagaacgaagtatggtattttgaaatccttactggtcataactactgtgccattaagatgccttctgacaaagcagcaatcattccaaactgttttgtgatcggtgatgtagacttaagcgataaagcgaatgttgtagcatctcctaatcttgtaaaactggctaagaataatggattttatgtagcggctcaggatggaaagggtgacatcaacgtaaaactttcttattcgggaaagggttatgcagcccataacgccgacagaattcgtggtggacagtatcttttaagtggtcaggataacacaggtatttatgatgcagattatcaggatcctttctttacctgtaagaatgttactgtagagaaaatgtatgaattagcaggatatcgttacgaaggcatgaactttggaagaaacatttcttacagaattggaagcagaagaacagcagaagctcatattttccagattaattcttctatgccaacagaacttgctaccgtacagtggttctctatggcaagcccagactactcaacatttgtaccattctatggagcattattaacagatgtatcaaaggcttataaaacagaggcacagcagccgaactctcgtgccgcttactggatcttccgtaacattggttacttatgtgaagagacaaatgacggtgacggaccaaacagagagaactatggtaaaggtgtaaagcagttctataaagcttacatgacaaagatggaagaacttcagaaaaatgtaaatgcacagatgcttaatgtttataagaatgacaaaaagaacttagaatattatgcaacaaaacttggtattgccatcggcaatgaaactatggactttgctaaggcaatgtacatggacatccagacatgtaaaacaaatggaacaaaatatgagacatcaagcttaagcgcagatgatatcgaatatgatttatcaatggtaacagcaccagcaaagaaagctgatgacacaaagcctgtaacaccggctaagccatccgcaccagctcgtgtacaggtaagggcaaaagcattaaagggcaaaaaagtaaaagtaagccttaaaaagactgcagaagcaaaaggttatgaaattgtttactccacaaatgtaaacttcacaaagaaaacaaccaaaaagatttctacaaagaaccttacaaaaacaatcaagaaactcaaaaagaaaaagacttactacatcaaagcaagagcttacaaattagatggtaagacaaaagtatatggaagatggagtttgatcagaaaggtgactattaaaaagtagattgccgcaggcaagggaagacgccctctgaaagataaatagaccatatttgtgactttagtcgctgcaggttgaatgttcgcttagacgctcgcattcaacctttgctccgaggccacaaatatggtctatttatctttcagagggctgtgctttggatggagatgaagttatttatcaaattaagtcaaagacagcaagaggaagtatccttcctcttgcgtctgtttacctcacaaatgaattaaattcttgcacatttcctcttgttgtgctatgattccccaagtgtattgaacataaagaagaaggataatcaggaatatactggtgggagaaaaggaatgaaagagaaagaaaaagatatttttgataagattatggcattgccgggacttaatatttttgaagggttttaccagaagtataaagagatgctcctgtatttattttttgggggaatgacagcggtgatcagtatcggttcctacagctattgtgatgtgggactgggatttgatccacttattgcaaatattatttcatggatcttggcggtgacatttgcttatgtgacaaataaggtatgggtgtttagtgtggagacacacggaatgcatgaactgtttatagaggcttttcacttttttacagggcgcttatttacacttattgtagaagaagcgatactgttaatttttattagtaagcttcattttaacagtatcgtcgtaaaagttgtggcacaggttgttgttgttgtcctaaattatattatcagtaagcttattgtttttcgtgagaaggaataacttctgtaacaaaaagatcgttagcatttactgaaaaatgaatatcaaaacctgcgtattgcataccgtagattcgttctgggtcatgctgataggaagggcgcgggtctaaggagaggcagtctaaaagagactgtcttttttcttttgggataaggtgcagcaaagcatcttcgcagtggacattcaggcggtgttccagtgcctttgtggaaaaacttcccagagcatctgggtgtgcatctgcaaaagaaagatacggcttaatatcataaatcggggttccatctaataaatctgcaccggaaacatagagaatggggccttctggagagtttggaacagccttttcaagacggacacaggataatccgagcggatttgggcgaaaaggagcacggctggcaaatacaccctttcgtttattgccaccaagtcttggagggcggacagtcggtgtccatttatctctttggtttttcgaaaattcccaaataagccacaaatgagaaaattcctcaattccacgaatacaatcaccatttcgaaattcttccgtaaaaataatctttgcctgtaaactatctacaagaccactctggcggggaataccgaacttctctgaaaaatctgaatgaatataggcaatcggctttatagaaagcataaccgatgtgtcttcgcatttcataaaataaactccttactatttaattcattgactaactaacagacgaagccaggaaaccaaatcctctatatttgtgactttcgtcgcggcgtgttgaatgttcgcttcactcgctcgcatccaacacttgctcccaggccacaaatatagaggatttggttttctggcttctgttttgtggctggagtagatgaatgaaacagtaggtggaggattgggggagtcctgaaattttctgcttgctctgaaattattgataaattgctgtgataattgttaaaaagagaggctttctctatattttttagttccgtatttggctatttacgattattctcgaataagcagaaaaactggcattacgtcctcaaatcctctcccactatttcattcatctattgtagccacagccagaagctaggaaattcacattgttagataacttttgtctttatcctcaaataccacaaccattatcttaattcaaacaaaatccatccaaagacagcccgagaagagaatcgataccctatatttgtggcctcggagcaaaggttggatgcgagcgggtaagcgaacattcaacctgcagcgactaaagtcacaaatatagggtatcggttctcttctcgggcgtctgtctcttaatgaattaaatagtactatatcattttggggagccgcaggcaaggaagaaaagtgaatttaccataagatacaaattgcgaaaagcaaggatttgcgttataataaaaatcagtatgtcggggcagtcttattcaatttttggaaagaaaacaaggactgtaacagcaaatataggaggatgaaaatgggagttttgaataatttagtaccagaaaaagttttttattattttgaggagttatgtaatattccacatggttcaaagaatacaaaggcaatcagtgattattgtgttaattttgcaaaggaaagaggattagcttatcatcaggatgccagtaacaatattattattttaaagaatggctctaaaggatatgaagattctaagccggtgatcattcagggacatcttgatatggtctgtgaaaaagaaaaagattgtacaattgattttgagaaagatggacttgatttagcgattgacggtgattatatttatgccaaaggaactactttgggcggtgatgatggaattgcggtggcaatggcacttgcgattcttgatgatgatacattagagcacccgccaattgaggcagtatttactgtagatgaagaaatcggtatgcttggtgcggtagcgatggactgttcttctttaaagtcacgtctgatgctgaatctcgactctgagaacgaagggcacttccttgtaggctgtgctggcggaatgatggtagagtgtgtatttccagcagagagaagacgctggagcggcaaagttgtttctgttcatgtgaacggagttactggcgggcattctggtgtggagattcagaaacagggagcgaatgcgaatgtaattcttggaagagtattatatgccttaaagaaaaaggttgcttttaacgtaatctgtgtggatggcggattaaaggataatgcgattacaagaagttccagagcaattcttatgctcgctccaggagaagaagagatttttatggatatcataaaagagcagcaggagattattacaaaggaatatcataagacagatgctaatatgtctattgaaggtttcttagaagtttctaaagaagatgaagcaagcgcggcaggtaagatgccgctgacagaagcttgtggtaatgcagtgatcgcagcgctgcgtacattcccatggggtgttcagaagatgagccaggacatggaaggacttgtgcagacttctttaaatccaggtattttagcaacaaaggaagatgagatttctcttactttctctgtacgaagcagtgtggcaagtgagaaggaagaactttatgaaagactggtgtgcctgacagagagtcttggaggtaaggtaaatcgttccagtgattatcctgcatgggagtatgtagaagattctaaacttcgcattcttatgggagatacttaccgcgaaatgtacaaaaaagagcctgtaatggaagtgattcatgcaggtgttgagtgtggattattctctgagaagatgcctggtcttgactgtgtgtcttacggaccagatatttttgatatccatactccgcaggaacgtctttccatttccagtactaagagaatttacgaatatacagtagaagtattaaagaggcttaaatagtggaaaagcaacataaggtgcagtgttacgctgcacctcttgaaggaattaccggctatatttacagaaatgctcatcagcatatttttcagggggttgataaatattttacaccgtttgttacaccaaagccgaaaaaagggttaaatacaagagagaagaacgatattgcgccggaacataataaaaatattcctgttgtaccacagattcttaccaataaggccgcagattttatcaaggtagcagggatgatggaagagcttggatataaagaggttaatctcaatcttggctgtccatccgggacagtagtttctaagaaaaaaggaagtggatttcttgcagatttagagggaatgaagtacttttttgatgaagtgttctctcaggtaaatatagaagtatccgttaagacgagactgggtgtggagaatccagatgaggttatagatttgatgaacatttataatgcattcccgatctcggaggtaatcgttcatgcaagggtcagagaagattactacaaaaggccggtcaatcaggaagcatttgctcagtgccttgctataagcaaacatccagtatgttataatggcgatttatttaccgtacaggatattgagaacttgaccgcaaaattcccagacattaaagcagttatgcttggacgcggaatgattgcaaatccacagcttacggaagtattttgtggaagggaagcacatggagatagtaccagtgttgaaaacaggcagggacttgattatgtgcgctggaaagcatttcttgatgaattgtgttatggatatgaacatatcatgtccggcggaaggaatgtcctgtttaagttaaaagaagtatggtcttatatgattacatttttccctgaaagtgagaaatatgggaaaaagataaagaaggcaaaaacagttgaggaatatcagagaatagtagatacactttttagagaaatggggatagtttaatatccccggaggtgaatgatatgtggaaaaaaacaaccgctgtgttaatgatttgtatactttgcataagtttttcttttcctgtaagtaatgcagcagaaatatcaggcacagcaagtgatgttacaaattacaagcagatatccagtctggtatccgatacatgggaaagcgattattttgaaaagatgattatttcgccaggttctgattcgatggaaaaggacggagagcaggagagtgtctcagatgaatttaacgtcagtgtctctaaggcaaaggagataacgaaaaccgagaattctatggacagctatcttgacaggcaggatggaatttatgaagtagagaagaatgatgacggtgatctggaagtgacagcaccgtatcagacaaagagaattattgtagagaatgataatgtagaagatacatatggcgcaagccatgtttatgtaaataaagcggatggcgagactattttgcagtatgatgcagaagaagatacagagtctgcctttgaggcattaaagcagacctatggaccgtcacaatgttatttagataaggttgtttctttagatgagacagctatgggacttcctctttctcaggagattgtggatggtgtggatagctattcctggggtaatgactatatgggaatgagtaagctcaaaaaggaagcggcatcttatgggtatacacgcaaagttaccgttgcgattgtcgataccggaattaatacttcaaacaggatgtttaaaggccggacaatttcttcgcaaagttataactttttcaatggaaataaaaatgtaacagatgtttttggacatggtacacatgtaagcggcattattgttgatgccactcctgcaaatgtcagtcttttagtattacgggttgcaaacagtaaagggcagtcttctatgcttacgataaagacagcgctgcaatatgccattgccaaaaagtctgatgtaattaatttaagcatgggatttattgatgcgaatgcagatttatataattatcttgattccacgattgataaggcgtatgagaagggaattccaatttcctgtgcggcaggtaatcaggaaacaggcggcatagatgtccgttattgttatccggcaaattatagtaagacgattgctgtgtctgcaattgattccagcggacggttagcaaactattcaaatagaggcaatggaatagactttgcagctccgggaacaggaattatcagtgcggattataagggaaatttgactttgcgtgctatgtcaggtacttctatggcagctccgcatattactgcggcaattgcatatttaaagatgatgcagcctaatttatcagtgaagggtgtctgcagggaacttgaactatactgtaggaatcttggtgccaaaaagtactatggcaggggatgcccgattctgacgaatttatttaaaaagggcattacgaataaaaagtatatcgtaatcttaaagccaacgctgagttctgtatcaaataaaggcagtggaataaaggttacatggaagaaagctacaggagctgcatcttattatgtgtatcgaagaacgaataatggagcctggaaacggagagcagtactctctgcttcttctaattcttacatagatagaaatgtaaaacagggaaagaagtatacttataaagtacgggcctataataatggaatattcggaaggttcagttctgaaaaaaaggtatatcgattaaagacgcttacgaatatccgggtaaaaaatacttctggaagacgggcagccgtgttgtggaagaaaaagacatacgcaacaacttatcaggtaaaatatgcagccaatccgtcttttaataaggcaagaaaagtttcggcaaataaaaagaacagccgtttaacaacaaagaagttaaagaaaaagacatactatttccagattcgttacagctacaaaaaaggcggtgtaaaaagctggtctgcctggtctaaggtgaagaaaataaaaattcgttagaattaaaaatgtaataaaaatagaaaacattacagaaagagaatcaaaccatgaatacggaaaaagaacaaaaagaaatagaagaaaaatggcagactgagcgcttagaaaagcagataaactttatccgcgaaatggataaggagaagtttatcgggagacagacatatttatccgatggaaagcgcaaagaaaatgatgccgaacacgcatggcatctggcattaatgaccttgcttttatcagaatacgcgaatgaaaaaatagataccttaaaaacgatgactatggtgttattccatgatgtagtagaaattgatgcgggggacacatacgcttacgatgaagaagggaaaaagacacaggcccaaagagaacaaaaagccgcagaaagactttatggcctgctgccagaagaccagggagcaaaattaaaagctatctgggaagaatttgaggccaaaaacacaccggaatcccgctttgcccacacaatggataaccttcagccagttattttgaatgcgtccacagacggaaaggcatggaaagaacatcaagtacgcctaagccagtttatgggccgacaggaagatacgccaaagggctccgaaacactttggagatatgaatgggaaaaactcgtaaaaccatttttagaaaatggaacaattaggggggatgaataattctgttcaatggacaaggagacgaaaccgagaaccccaatagcatcctatctgtgactttcgtcgctgcaggctgaatgttcgcttacacgctcgcatccagcctttgctcccaggccacagataggatgctattggggttctcggtttctgtctttggcaggattgaaagggatttttctatggtgttgcagttatgaaaaatttttcgggtgcgttatctatggatagattgaatggaagctttctatgggattgcgttggttgaattattcaacaattttcatacagattgagacttcacttcaaatcaatcaaaagatatgtgagttttccctttataagtatatgtgcctgatttgtggagccaaagacagaaaataaagccaaatttattttctttgcctttgatataggattttcgtaaaataaaatgtgtgggggaaaattcaggtgtgagtttattcaaagactgaatgaaaaaagaacctttcgatactataatttttgacttttgcgctatggaattttgactgtaagtcctgcgagctcgttttcgagcaggacttgttttatcaggcaaaatggaatgtttagcgcaattgaaaaaattatagtatcgaaaggttcttttttgcagtacactttgcaattgatataacacctgaattttctctatttacaggaagaaaatcagcatatcaatcaaaaatactggtatcaggcagcttagtgaccagagcatatatccaaagaaagatggcattttaataccgttctcctctgcgatggagcgtaccataaagttcggagcgttaccgatataggtattagcgcccatgaatacggcaccgcaggaaatcgccatcagaattgtctgtggtataaagctggtcagtgtctgtataccggagctaaatcctaaggaggctgcagttgtgaagaataccaggtaagtcggtgtgttatcaaggaagcttgataatgctccggttatccagaagaactgccagggttcagtcagtccaagactggaaccccgggcttttaaaataaggagtgccggaatcatcgtaataaagataccgatgaaaagaatggcaacttcctgaatcgcatcccaggtaaaatggttgctgctgcgaacttcctttttggttgtcttaaaggaaagataagcagaagcaagaatcatcgcaatttcgataatggaagcataggataaagttacacccattatagtaagtccttcgctgaaaacagggaaggttgttggaagtactccgcttaaaataacacctgcaacgatgataagaagaaagagaatgttgtgtgctccgtctaaatgaagctttactctgttttcttctgttttcatttccgggcggaaaccggcagcaatgtcttttttatatgcccttgtatcaataaggaagaacaaggtcagtaaaataatgacattaataatcattacagggagaagatggagactccagaaaaagtcaacaccgttcataaatcccatcaaaagtggcgggtcacctacaggggtaagacagccaccaatatttgaaatgaggaaaatgaaaaataccataatctgtactttacgctgacgccatttatttgctcggataattggacgaatcatcagcatacttgctccggttgtaccaatccagcttgaaagtaacgttccgataaggagaagtacaacattaacctttggattgccggccaaatcgccctgaagactgatattacctgcaacacagaaaagaccaaataaaaggacaataaaagtgagataatcgcccagtgtaacctctatcagatgttctaaagcgacatgccctccaaaagcgatggcaaaaggaatgaggaacagcaaagaccagaaggcaacgacccagggcttatgtttttcccaccattcttcctttatcaaagggaaaatcgcaatacttaaaagcataccagcaaaaggaatacaactccatataggaagggtgtttccgagtgcagtatcggaaagaccactttcagcagcaaatacatgcagaggactaaacagcaaaaaagccgacagtccgattaatagttttttcatttgttaaacctcccgtatgttggttttgtatttttttattataggcgaaagtcagaaggcagaattcaccaacgtaataaaataactaaactcatactaagacgaaggcatttccttgtcaaaggacaaagatagtgatttgtctaaaatggcggaaaaaattataaaaaaaccaagaattttatgtaaaataaattaagaaaaagcttttctatctgtttaaaaataatacgatgtttgctataatatgtcatatcatggaaaagggaaggacatggacgtgaaagaagaaattagtacaataaaacagataaatagtgaagctacgccgatagtaagtctttccgttacgaatctggatatcgaggtggaggaagggaaagtttataaggactcttttttcatcgagagtgagaataaagttccgatagaaggatatgtctgtacaaccagcgataaggtggagacagaggctgaacggttagagggaacccggcaggagattcctttttattttaaagggaaactggctactgcggggaatacttttgagggagatattgtcttaataacgaacggcggagagtataatattccgtactgtgttaaggtaattcataagtttgtggaaagttcgggtggacgtatctctacaatggaagagtttgtacagatttatgagaataatagaaaagaagcagtagatatatttttcctgccgaattttgaagaagtgtttcttcagggaaagccagaacaaaaggagctgtatcacagcctgatgaagagtcgttctaaaagccttattctggaagaatttctgaccgctgccggttataagaatacttcatttcttgatgtatcacaggataagctggttttagaagaagaggatagcagcgcacagcttgaattacttcttacacagccaggatatgttgagggaagtatctacagtgaaaagggtcagattcagatttcaagggaacgtttttccagtgatgattttacagatgggaagctgctttttaatgttgagaagaagcagaaccttttaaatggcagtgatatcattcatattgataccgttcgtcaggatattgagatttctgtagaatggtgggcgaagcagacagctttgactaaggaaaaggagaagaagttataccttaagaaaaagagagcacagttaatgcataactatctgtatttccgaacaggaagtattgcatttgaagattttgcagaagattccgggcatgtattagaagaattgtcacgatatacagaggataatgagtggaagctttaccgaatgcatttcttcttaatggaagagcgaaaagaagaggggaaggaactgttagaactcttagaaactatttctcaaagagacgaatttacgccattagaagcgaattactttttatatttaaaggcaatgtattacagaacaccggaggcaatcagcaaagcagtatctacgataagggagttttatgagttgtcagaatataaggcagaagctttgtggatgcttatttatcttgatagagagtatgtgtataacaagcgtctccaatatgatacaatccgtcagttgtttgaagaggggaataacagcagtcttttatattttgaagcctgtgatattttgaatgagaacccgaattatatggaagaactcgggaagtttgagataagtattttccgctggggtgtgcggtatggatatatttctttatcattatcctaccagtttgcgcgtcttgccttaaaggccaaatactacaataagtctatttattatattgcggagaaactgtatggagtagagccggatgagcagtttttacaggtgatttgttctcttcttattaaggggaatcgtacaggtaaggaatatcatgaatatttcagacttgcggtagaggccaatttaaagattattggtttgaatgaattctttatccgcagtatggattttgagacgtatgatcttattccacagagagttttgatctattttacatacagcaacagtttagattatttagagaaggcatatttatatagcaacgtgcttcgcaataaagaaaagtatgaggaagtatatggagcttactattctaagatgctcccgtttatagaagaacagcttttaaaaggaagaattaatgaacacctggcttacttatatacctgtttccaaaaggaagtactggagaaaccagataactggaaagctgtctgtgatattttattctaccataaattaatctgcacgaatccacatattattggggtgtatgtttcctgtccagagcttggaacggagaagtattatccactttccggcggaacgggcggggtagagatttacaacgacagggcagtactttattttgtagataataatgagcagcgttatgtgaaggatattaactatcagttaagggagtttttatctccacagcagtttgaggaagagtggatacgcaggaatttatccaatagaaagattcttcttatggaatctggcaaaatggaagagaatataaaagagcagactcttccagtattgcagagaattgtatttaatgatgattttacacggtggatgcaggtggaagccgtagaaaagatgcttgtctattatgagaatcatcaggataagcggaacctggcaagatggcttggcaagattgactattcgaatatttctacagaattcagaaagacattgatggattactatatggaagtaggaatgatggaagatgctttctttggaatcgagctttatggatgcgatattatgggtgcggcaaagattttgcgtctggcatcatttggagcacagtgctatcagggaaaagatgatgaagcaaccctttctttggcttatgcggcatttatccgtaaaaaatgcaataaagatacgcttacctatctgatgaagcattttaagggagagacagcagctctgttggaaatctgggaaagaagcaagcgatttgggcttgaaacagcagcctttgaacgaagaatacttgagcaggtaatgtttactggcaatgatacagagggcgtatttcctgtctttgaatcattttatgcaaccgatgagggtgacgaactgattgaccgttatcttgaatatgcttccatgaaagaactggaaagttcaatggaactgaatgattttatgcacatggcgattggtcaggaaattgtaaatggcagaatggaaaacagacattcaagaattcattttctgtattattttgcaggaagagaagactggtatgatacgataaaagatacggcagtttatattattaatggatttttgcaggaagaattttatctgccagtttatcaggcatatagtcagtggattacgttcccgattcattatcaggagatgacattccttacttatcatggaagagcgggaagtaatgtgatactccgctaccagattgatggagaagaatattctctcagagaattacatttagaagaagtacttccgggaatgtatgtgtgtcacatgaacttcttccagaaagatcatgtaaaataccgtcttgaatcggatggaagtccggtagatgagggggctggtttagagtttgaaacttttgaatatggagacggagaagagagtcgtttcttcacattgaatcatttagattctgaggagtcttctttgccggaggtaaaggattgtcttttaaaaactttttttgcagaccagtatatgaagcttctgtaaatagaaagataagttaaaaaagcagaatgagaggtttacaatggaagaactggaaacaaaaaaatatgccggaatagacttaggccgtacttctgtacagtttagcatataccgtgagggacaggaggagatgacagaagaaagtttcctcctgtctgaagaagaacaaaaagaatatatagagtctgggatgcggcaggttgaaagatatatggagacaggagggcttcggtggcctgattttcaggcggttcatttttcgatggaggatgcatcggaggagaatcggagtaagctcaaatcggcagtgagtgaggagcttcggaaactgcatggggtgaaggttatcacgcatttcagagcctttgcagaatatgtatttcatcaggaaagaatcatgtgggaccgaaatacgcttttgttagattatcatgataatcagcttagttatgttttgattgaccagatcagacgctcaaagcagaaggcataccgggcattgcagcaaagaattgatttaaatgagtaccgcgtagcagaaggaacaccggagcaggatcagaactttggccagatgatgaagcggttccttgtaaagaatccggcaaatatcattttccttacaggaagtggatttgagggaaactggatgaaaaagacacttacctatctgtgtgcaggaagaagagtatttttaggacagaatctttatgccaatggagcatgtcttttgggaattcattcgattgaactgatggatgagggaatgattcttatggatgggcctgatatggtttaccatactgtcggtgtcgttacaacagaagcaggtaagccacagtatgttccgattacttcaattggaagagaatggtataatacacatggaagtgtggatattattcttgataaaagtcagagagtggatttcttttaccataatacgaaagagaatgaaattgagggagccgcctgtgatatcaaaggacttccgaaacgaccgccaaagacaacaagaatccgtattgaagtcagctttacttcgcagacagagggagtgattcttctcaaagatatgggatttggggaaatgttcccggcgacaggaaagattatcgtctttccgtttacattgatttcgtgatctggagtgactttttgacacgctccagagaattttcgtaaaaagaaagaggtagagaagatgagagaatcactaatctgtattggaaagattggagaaaaaggatattattttgaggatacaggaatacagattttctcctatgaagaactttgctattatatgagtcagcatatgatctgctatattcatacacttccaggagaagatttgctggcctatatacgggatgaacttgatttagataagctgtcgaaacagttatctaagctgcttgatccggaaaaagatcagatgaagtattttgcggcattgttccgcgaaggtcattattttaatgaggacgaaatcagggatattcttgatgaatacagaggattgatgaatgcccctgtctatttacaaaaaaagtggatgggagatctgcttacgagttcaggacgggcttcaagggcgatacggtattatcaggaagcattagggcaaaaagagataaaggaagaagaagtcggacggctctatcataatatgggagtggcagaggcaaagctgttccggtttgagaatgccaagattaattttataaaggcatatcagtatacgggagaagaaagttccttattttattattattgcatcatggcactggctgatggaattgaggcagccggagaagaattaaagacctttgaagactctgattttctgctggatgcttttgaagaacagttcgctgcttttgaagaagattttgcttacagtgcaatggctgaaaaatatagaaaaatagtatttttagatgaaaatggaaagccggaagaggctctggcgaaaaaacagagactggtaagtgccttaaagaaagattttcgaaaagaaattgacatttagggcaaaatattagtgacaaattcgcaaataagttatactatgatagtcagagctttttttgctctggtgtattgtttttgcagaataagttaaaacagtaaaaatatcatgtgctttttgtagtgcatgatttacaggataaaaaccaggaggaatgaaacatggcaacagagatgaataagacctacaatccttccgagattgaggacagactttataaaaaatggctggataagaagtatttccacgctgaagtagaccgcagtaagaaaccttttactatcgtgatgccaccgccaaatatcacaggacagcttcacatgggacatgcgttagataacacattacaggatattcttatccgttttaagagaatgcagggttacaatgcgttatggcagccaggaacagaccacgccagcattgcaacagaggtaaaggttactaataagttaagagaagaaggtattgataaagaagaacttggacgtgagggattcttaaagcgtacatgggagtggagagaagagtacggcggacgtattgtcagccagttaaagaaactcggttcttccgctgactgggacagagaacgttttacaatggatgaaggatgttctaaggcagtacaggaagtatttatccgtctttacgaaaaagggtacatttaccaggggtcccgtattatcaactggtgtccagtgtgccagacatctatttctgatgcagaggtagaatatgaggatcaggcaggacatttctggcacatcaactatccgatcgttggaacagataagtgcatcgaaatcgctacaacccgtcctgagaccatgcttggagatacagcaatcgctgtacatccagatgacgagagatataaagatttagttggaaagatggttcttcttccaatcgtaaataaagagattccaattgttgcagattcttatgtagataaagaatttggaactggtgccgtaaagatcacaccagctcatgaccctaacgactttgaagttggaaagcgtcataacttagaagaaatcaacattttaaatgatgatggaacaatcaatgagaacggtggcaagttcgagggaatggaccgttacgaggcaagaaaggctatcgtaaaagagttagaagaaggcggttaccttgtacgtatcgagaaccatgagcataacgtaggaacgcatgaccgctgtcacactacggtagagccaatggttaaaaaacagtggttcgtaaagatgaatgagatggcaaaaccagcgatcgaggcagtaaagaacggtgacctccgtttcgtaccaggtcattttgaccgtacttaccttcactggttagagaacatccgtgactggtgtatttccagacagttatggtggggacacagaattccagcatactactgtgatgactgcggtgagattgttgtagcaaaagagactccttctgtatgtcctaagtgtggatgtactcatttcacacaggatgaggataccttagatacatggtttagttctgcattatggccattttctacattaggctggccagataaaacagaagaccttgattacttctatcctaccaatgttcttgtaacaggatacgatatcattttcttctgggtaatccgtatggtattctccggatacgagcagactggcaaatgtccattcagtgacgtattgattcatggtcttgttcgtgatgagcagggtcgtaagatgagtaagtctcttggtaatggtattgacccattagagattatcgaccagtatggtgcagatgcccttcgtcttactttagtaactggtaacgcacctggtaacgatatgcgttactctgagaagaagattattgcaagcagaaactttgccaacaaagtatggaatgcttccagattcatgttaatgaatattgaaaaagcagacctcagcaacgtatctcttgatgatttaacaccagcagataagtggatcttatctaaggcaaactctcttgtaaaagaagtgacagataacatggagaattacgacttcggtgttgctgtttccaagttaaatgattttatctgggaagaattctgtgactggtacatcgagatggtaaaaccaagactttataacgaagaggatacaacaaaggcagcagcactctttacattaaagaaagtattgacaatttccttaaagttattacacccatatatgccatttatcacagaagaaatcttctgcagcttacaggatgaagaagagtccatcatggtatctgactggcctgtattcgaggaagcatttgactttaaggcagaggagaatgaagtagaaatcattaagaatgcagtaagaaatatccgtaaccttcgtgcagatatgaatgtaccaccaagcaagaaagcaagcgtatatgtagtatctgaaaaagaggaagttcgtaaagtatttgaggactccagagtattctttgcaacacttggttatgcaagcgaagtacatgtacaggcagataaagctggtattgcagacgatgcagtatctaccgttatccctgacgcagtaatctatatgccatttgcagagcttgtagatgtagaaaaagaaatcgcccgtcttgaaaaagaagcaaaacgtcttgagggcgagattaaacgagccaaaggaatgctctctaacgagaagttcataagcaaagcgccagcagcaaaggtagaggcagaaaaagaaaaattagagaaatacacttctatggcagcacaggttgcagagcgtctttctcagcttaaaaaataaatagagataagagggatagaggaatgatgacctacagcgaaatggaacgggaaattaatgagatacccaagttcggtgccaaagcaagtctgtccaatctctccgattatctggaattagcgaatcacccggaaaggaatcttcgggtgattcatattgcagggacaaatggaaaaggttcggtcagcgcatatattgactcgattttaagacaggcagggtatacgacagcattatttacctctcctcatctggtaaagattaacgagagatttcgtattaattttaaagagtgttctgatgaagaattgattttagcgtggtgtcaggtgaagtcttttatggaaaagggtgagaagcagggattgcagcctcttacattttttgagattctttttctgatgggaatgattcttttttcacaaaaagaaattgactattgtattttagagaccggacttggcggacgtcttgatgcaacagtactttcagatccagtactttccataattacttccatcagttatgaccatatggagattctcggcgatacgattgaaaagattgcagcagaaaaagcaggaattataaaaaatgggataccagttgttgctgttgatgaagaaaacggggcatttcctgttatcgaaagaactgcgaaagaaaaaaaatccccagtttacgggctgaaatcgcaagaccttacaattttaaaaaaatacgagaataagattgatttttctatcaatagccgttattataagataagtaacttaaaggtaaagagttatgcttcctatcaggtacagaatgcagcgcttgccgcacttgctgcacatgttcttttgccagatttggcggagaatgttatcagaaatggcattttagagatgttctgggctggaaggatggaagagattgcagagaatgtttatgtagatggagcacataatccgggagcggttcgtcagatttataacagtttagctgattctgataaagagtggctcttattgtttgcagtctgttctgataaagattataccgagatgattcgtatacttggaaagattccgtggaagagaatatacattacaaagatagacagtgcaagaggagcggatactgctgcggtcagacagtgctttgaagaagcggcaggatgtccgatatgcgaatttgagagtgccggtgaggcatttaaggcagctttacgagatagaggagatgaaaaagaagagaatcttttatgtcttggctccctgtatttagtgggagagataaaggaacttgcagcaacaatgttttgaaagtgaggatatatcatgtttgattatgatttagagttaaagaagtttaaaccagcagtaggcgtagaaatcggtgaggatgagctgtttagtgatgacattaaggatataacagatcttgtagaagaactggtagcagagcgtgagggaaagaaagcttctaagtaagtttagtaggaggaatataatgaagtgtattaaatgtggtcggccagtcggcgcgagcagatactgcaacgcctgtggttttgacaataaacacatagcaaaagcattaaataccgcagattattattataatatcggccttgaaaaggcgcagatgcatgatttaagcggcgcagagatttatttaaagaaagctctcaactataataagtcccacaagaatgcgagaaatcttttaggtcttgtctacaatgagatgggagaaggcggaaaggcctatatccaatggaagatcagcgcaaagctttcttctgtagaagagaacgttgcgaatctttacatccgtcagatggaagaacatcctgcagtatttgaggagatcaacgagacagcaaagaaatataacaccgccctttcctatgcgaagcagggaagcgatgaccttgcaatgattcaggtaaagaaggtacttagcatcacaccaaactttgtgaatgcacatctgttatttgcccttcttcatatgcgtgcaggagataatgtttccgcacagactgatttgaataacgcacttgcaattgaccgctataacacaacagcacgcaaatatctgaatgagatgggcgagaacccggacactgtaccggagaagcgtccggcagatgccttaaaaccggataatgaaaaccttagaaatgtacgtccggtagaccattatgaagatccgaacaaggaaacatggaaacagtttgtttacatgctgattggtcttgctatcggtgtagttgcgatgtttgttcttgttattcctagtgtaaaggcaagcgtaagcgttgactataataacttaaagaaagagtacagccagactacaaataaaaaagatgcagaaatcagcacattaaaagatgacaagaagagcctccagaaaaagaataagaagcttactaagcgtcttaaagtttacgaaggctccaaaggcgaagacagcatgtatgacagcatcttaaaggccagtcaggcatactccagtggaaattatgtggaatgtgcaaagcatctcttaaaagtagacaaagactctctgccatccacaacagccaagaatttatatacatccatgaaggataaagctttccagaatgctgcagcacagttatataacagtggaaaggcttcctttgatgcatataaatatcaggatgcattagatgaccttgagcagtcctataagtatgataagagctacaatacagagtatcatattgcgatgtgctataagtacttaaataagaatacagataaggcacaggaatatttctatgatattatcaataattcaggagatagtgagctgattcgtaaggcagcaaatcttggtcttgatatggtaattaactctgcgaaagaagcagcagcgaaggcaaaaggcggaagtacaacgacagactctaagtcagatactgcgagcagttctgattcttccacatctaagaagagtagtacaaagagtacaacagaagaagacttcggtgcagatacatcaaatagcaataactaattttataaaattattacgaataaaaataagttcgacaaaatatgtcggacttatttttttgttttcggtaaaatatagttattcagagttaaatattacaataaaaataaaaggagagggaaaaatgggatgctgccatgtaaaaaatcaatgtttagttatcagacttccgaaagaaattgatcactatcaggctgaaaaagtaagaagggaatgtgagcaaagtttcatgaaatttattatccgtgatattatttttgacttttccgatacatcctttatggacagttcaggaattggcctggtattaggacgagtgcggaagatacatccaattaatgggaaggtatatctgtttggagggaatgaattaattcaaaagatgtgggaaatggcaggaatattaaacctggttacagttttagacagtattgaaaaagtaaaggaggtatacgaatgaaacaggcaggggagaatagtaacagtttaaaaatggtatttcgtaatcgcccggaaaatgaaaaaattgtcaggacgacagcagcggtatttgcttcggtattagatccgacattagaagaaatatctgattttaaaacagctgtttcagaggcagtcactaatgcgattatccatgcctatccaaaaacaggcggcgatattgaggcgtattttaaaagagaagataaaaagataacagtacttataacagactatggtataggtataaaagatgtcggaaaatcgatgcagccattgtattcaaccctacatacacaggaacgttccgggatgggctttacctttatggaagcattcgcagatgaggtaaaagtgaaaagtgtacccggaaaaggaacgacagtaaaacttataaaaattatagggaaggggaggagtgtggagagaacctgtgaattaattaagcaggcaaaagaaggaaataaagaagcacagtcaatattagtagaagaaaactccggtttgatctggagcgtggtaaaacgttttcagggacggggatatgataaagaagatttatttcagatcggcagtatcggactgttaaaatgcattgaaaattttgatttagaaagaaatgtaaagttctccacctatgcagtaccattaattatgggagaaatcaagagatttttaagagatgacggtattgtcaaagtaagccgaagcctaaaagaggcttcttataaaatcaaaagagaaaaagaacactatcaaaaattatacaatagagaaccaacattaaaagaaattgcggtcaccttagatatggacgagtccgatatccttatggcaatggaatctggtcaggaggtgtgttctctacaccaggtcatttatcagagtgagggagatgaaattcatttagaagataaactcgaacagcaggctgacttgatagaacagaccgtagataatatatatgtacaggaattattaaaaaaactaaatgagcaggaacgccagattatccatatgcggtacttccaaaatcagacccaggcggcgattgcaaaaaagattggaatttcccaggtacaggtatctaggatggagaaaaaaatactgaataaattgaggaagaatgccaatactaaggaaaacggaaatctttgaggaatttgttatggagaaaaaaattatttatctgaaggcagagcagagttcctatgtaaatcatgaaaaaattcatattggggacattgcttctgttttttgtgaagataaggagatagagaagaaaatcaaaaatattgttttatatgagtttgatgagaaaaacgaaaaagaagggagagtttttctatcaatcttattattgattgagaaaatttcggaacagattccgtatggtgaagttcgaaataccggtgagactgatatggttatctattataaagcagaagagctaaaaagcaaaaaatgggtacaggtgataaagattttatttatttgtgcgacttgtttttttggagcaggcattacagttatgggatacaataatgatgtagacatggtgaaagtatttggccagctttataaagtatttcttggaacaaagccagacgatcctacatttgtggaactcttttattctgtgggactggcattgggaatttttctgttttttaatcatgttccggggaaaaaagttacaaatgaaccaacaccaattcaggtgcagatgcgcctttacgagcaggatgtaaatagaacttttttattgggagcctcacggaaaggagaagaactggatgtgtctgggaataatgacagtgccaataataaataaagttattttaggctgggttgcttttggtgcaggatttgctgtggcaggtgggtttattgcatttatcagtttgattggaattgtaacaaggctggcaggactcacgaaaacggcagacgcaatcccgacctacgaaaatagcatggcattaggattgattttttttaatctcgtatcattatatcaaccagacttgcagtggatttcttatacggcagctcttagtataatcaatattgtcggtctttttacaggaatatttgctggatgtcttgccggtgcacttgcggaggtagtaaatattattcctatattttccagaagaatcaaactgagaaaaggatttccttacatggtaaaagccgccgcagtaggaaagtgcataggctgtttaatacaattttatgtattctgatttgttgaattggcaaaactgacgaaacatcgaaatcccatcgtccatatttgtgattttagtcgctgcgcgttgaatgttcgcttatgcgctcgcattcaacacttgctccgagaccacaaatatggacgatgggatttcgatgtttctgacagtggtttctgaagtaaaatcagaattcatgctggagggatttggggaagaggacaggagatgtagaagttccggaaaatgaaattctataggattgatacttgacccagtgccataatcgtatagttatggcccctacttttttctattaacaagagcgtgtttacgaatttatttaagccataactgtctgaaatctccctcaaatttcaccaaaacataaattctgactgttcttcaacttccaaagacagctctcagagaatgaaataacctatatttgtggcctcggagcaaggtttggatacgagcgtgtataagcgagtattcaaaccgcagcgactaaagtcacaaatataggttatttcattctctgagagcgtctctttgcctgcagcaatcagaatttaacaaaaccagttgacgtatgaagtggatacaggtattatacaattcagaaggctcctctcttttttggagggagctgtttttgttttaaaattaaaatgaccgtgaaaggggtatatacttggaagaaagaacaaaagcactgctcgtcggtgtgaatttaaataatgatccagaatttgagacagcattaaaagaattagaaagtctggcagaggcctgtaacatggaagttgtcggagtggagacacagaatgtaagccagattaataccggtgtttatgtaggaacaggacgtgtggaggagattaaagctgttgcccatatgatgggggcggaggtgattatttttgataatacgttatctccaatgcagcttcgcaatctaaaggatattatcgagagaccggtatttgaccgtacacatctgattttacaaattttctcatcaagagcgagaacaagagaagcacagattcaggtagagacagcgagacttcagtatgaactgccaagacttaccggtatgggagaaatcttgagccgtcagggaggcggaagcggcggattatctaataagggagctggtgagaaaaaacttgaattagataagcgaaaaatccgccacagaatcagcgagttaaagaaagaacttcgtgaggtagagaagaacagagagacgcagagaaagcggcgtttagtgcagggaatcccacaggttgccttagtaggctatactaatgcaggaaagtcaacactgttaaatgcatttattgataaatacgaggagaacgaagaaaagaaagaagacagaaaagtaatggcaaaaaatatgctttttgcgacacttgatactacagtccgcaagattcatttgccagataaaagagaatttcttctttccgataccgtaggatttatcagcaaacttccacataatctagtagaagcattccattctacattagaagaagtaaaatttgccaatcttctgttagaagttgtagactattccgatgaacattatatggatcatatggaagttactcggcagacattaaaagaacttggcgcagatgagattccatgtattcatgtctttaataaatgcgatattgcaaaggcaaatgggagagaagatgttccagcagaacttccgcatatcggaaaagactgcatctatatggcagccggacagaatattggtttagaagaactcgtacagcttatttctaaccatatttatcaggattatgtagaatgtacgatgctgattccgtatacggaaggggcattggtgtcttatttcaatgaaaatgcaaccgtaaaagaaacggaatatgaggcagagggaacgaaaataacgatgagctgtctgcttaaagacctcaaaaaatataaggaatatgtaattctataggtcgatttctgattgccgtaggcaaaagagacgctcccaaagagagagcataccctatatttgtggctttagtcgcggcggtttgaatactcgcttatacacgctcgtatccaaatcttgctccgaggccacaaatatagggtatgctctctctttgggagctgtctttggctgcctatgcaaactcagaaattgttttgagaaagatttgaggcttctacatctcctgtcttcttccccaaatccctccaactgattttctgctccgcagcctcacaactcagaatttctctattgaagattcagtctctttgtcatgatgtatttacttcccatccagcatacggctatcagaataatattaaagatgagcccagtaatcagaattggattaaggaaagtttcaaaggagtagttattgctgtaaatattcacccgcataattgtagtgctgccgaagtatccccagactacaagctggattaatccaaatatctgctgaacaacataaattccaacatatgccccaatggaagcaagtactttgtggctggaggcaaggtttccaagtgtgatactgaaaaacagtataccaattgccaggaatggtgatagaacaagggcaataataattaatgttgtaaagagcggtgtctggcttgcataacgtatcagagtgctccagaaaatactaaagttagagaaaagctctgtacttcctaccaaaataaagatagatatgctgataactacaacgtcaataagaagccatagtaaagcagcaagttcttttgaaagcaaaagctgtgatggtgttacaggcagggtatttgtaaggtagccctggtcggtaaatacatttttatgaaaatgatagccgctatatatataagtaaagatagcaatacttgaaatgacaatgacaagagcaaaaataagaagcattgtcaacgtgcctatgatagtggaatcggtgtttaataaagcgtctgttcctccgcttattgtaaaataaaagcgagataagagggcaaataataacacgaatccatgaattggcagtagaagctttgaaatagaacgccattcatatttaaataattttcctaacatttgaatacctcccggaataatacatccactgattttccctgattaaaacgaatatcttccacatcattttttaggacgatatgtccgtttttgataaaaacaacttcatccaaaatattttccacgtcagaaataagatgcgtggaaatgaggatggtggaatcgggttcgtaattgttgataatcgtacttaaaatgtaatctcttgcagcagggtccactccggcaatcggctcgtcgagacagtaaagtttagcgcggcggctcatgacaaggattagctgtactttttcttttgttcctttcgaaagggttttgattcgggcattagaatcaatgtttaacttttctaacatggaaattgcccggcttctgtcgaagtctttataaaagtcctcaaataatgtaattgcttctgaaactttctgtgtttcatctaagtaggtacgctccgggagataggagacgatttttttcgattcgactccaggggtatttccattgataaaaagttttccgcctgttggagcaagtaatccgttgattaacttgattaaagtagtctttccactgccatttggcccgagaagaccgataattttaccggattctaaggaaagagtaatattgtcgagtgcctgtttgcggccatattttttggatagatttttacattccagaatcgtactcatttttgattctcctttccgagtttttcaagtaaagtgattgtcttttcgtaatcaaatcccatctgtgacattttattaagaaattctttgatttgtgtggatgccagttcctctctcattttttcaatcatagctttgtcctctgtaataaatcgcccgcttgttcttgcggaatgaaccagattctctctttctaattcggaaagagctttctgcattgtgttgggatttacccccgcctgagcagctaaatctctgaccgaaggaagtttgtcgcccggctgatatttgcctgatacaatatccagcgatactttctcgataatctgagcgtaaattggacggctggagtcaagattccaagacatttataacacctcctttaagttatcaacacttacattcaagaatgcctcggcatttttgctgcaagctgcgcgtcatctcacatctgatacaattctattttgcaggaaaatgtaataaattccttacaataaaattctgtattattgtactaagtgattaatacaataatacatgtagaacgagaaaatgtcaacacaaaataaaaatattttttcgcccatgacttttttgcaagtttgagatacaatggtgagagtgtatttaaaatgagagaagattataaaaactagagcgtgtttgaaaaatgctttctgcaagatgtgcgttgcaatttgtgggagattttgcctgaatgagggcggcgtagcgggctacgtcaactgaatgaaggcaaaatctcccgcaaattggggcgtgcagattacgggaatgatttttcaaacacgctctaaagaggagaaaactatggaaaataaaaaagcatttggtcatgctcttgccatttttacgatttttatacaatataacacaaccgtgggacacacggggatagctcgcttatgcttagcacagtagtgttatcgaacgagaaccaaacttgccgaggttgggaagcccccacctctacaggacgccactgaaaaagtggtcgtaaaatcatatatctgatataattaaggtatcataattgtcggaggttgaaatgttatcatcccaacttaaacttagccttagttattattcagatttatatgacatgattgttccaaaagatcatattctaagaaaaatcagggaattggtcgatttttcttttatatatgatgaattaaaaaataaatattgccttgataatggacgtaatgcaaaaaaacctatattgctatttaaatatctgcttttaaaatatctttataacctttctgataatggtgttgttgaaagatcacgatatgatatgtcttttaaatattttctggaattaacgccagaagaagaggttatccatcctagtcttttaaccaaattcagaaagcagcgtttaaaagatgaaaatatacttgatctgctcataaataaaagtgtagaacttgccataaatcaaggtgttttaaaaagcaatactataattgttgactcaactcatacagaagcctgttatcataaaactactcagagagaaatgttgaaaaaagcctctacttctttaaaagtagctttaaaagattctgataaagacatttatctgccagatgaacctgaaaaacgagcttctttagatgagtataatgaatactgtcatgaattattaaacacagttcaggaaagtccgtattcagaactgccaacgattaaagaagaatcttctatgttatccgaaattttggataatcagattgattgttatgatcaatccattgacccggatgcccggattggccataaaacggtcaattcttctttttacggatacaaaactcatttggccatgacagatgaacggattatcactgcagcaacaatcacatccggcgaagcatttgatggtcaggaacttccagtactggttcaaaaaagtaaagcagcaggtgcaaccgttaatgaagtaatagcagataccgcatattccacactggaaaatttaaaagatgcacaaagcaatgactataaattaatttcaaagcttaacccgagcatcataaaagggactcgttcagaggacggctttatctttaataaagatgcggataccatgcagtgcccagcagggcatttggctataaaatatcgaattgacaaacgtagtaatcagaaaaagaatacacgtatcaaatattttttcgatattaataaatgccatgtctgtccttatcgtaatggctgctataaagaaaatgcaaaaaccaaaacgtatagtatcactattaaatcggattatcataaaaatcaagaggcgtttcaaaaaacacaatatttcaaggaacgtttcaaaacccgctatatgatagaggcaaaaaatagtgaattaaaaaatatacacggatatagtcgttgtgatgctgctggactatcaaacatgcaacttcaaggagcagtatcaatatttgcagtcaatttaaaacgaattttaaaactaaagggagaagtctgcccaaatgagaaaaaataggaaaattcatctctcaaaagggtagattttgcatccctcaaaacactattttagcaatattttattatcaaggaacattttggcatatatttgacgccctgtgatactaaacttaccactttttcagtggcgtcctacaggtgggggaggatgtcacaggatgcgttattgcattgattggcatttccatcattagctttagcgggacaacgatgcatttaaatccaattggagatattttgtccgttggtgcggcgatggtatggtcattttatgcagttctttcaaagaaaatgggagcctttggctattcagttatccagacaacgagaagaacctttttctacggaatcttatttatgattcctgcattatatttctttgacttcaaatgggacttgtaacgattctccacaccagcatacatattcaacattttctatctgggacttggcgcatccgccatctgttttgtgacgtggaatctggcagtaagaatccttggagcaatcaagacaagtgtatatatttaccttgcgccggtggtcacagcggtagcatccgtcatcgttttacatgagaaaataacttttctttctggattaggaatcgttctggtactcggtggtttgcttttatccgaacaaaagaaaaaactttttcttattaggggtagaaagcacacggaaaatgttgtagaataaaagataaatcataaaagacaggaggaacatctttgaaaagagaaaccgttatagtaatagacttcggtggacagtataatcagcttgttgcacgccgtgtccgagagtgcaatgtatactgcgaaatctattcttataaaacagatatcgaaaaaatcaaagccatgaatccaaagggaatcatcttaactggcggaccaaacagctgttatgagccagattccccaacttacacaaaggaactctttgaactgggaatccctgttcttggtttatgctacggcgcacagcttatgatgcatatccttggtggtaaggtcgaggcagctccagtacgtgagtacggaaaaacagaagtattagtagataaaaaagattctaaaatctttgcagacgtatccgagaaaactatttgctggatgagtcactttgactacatttccaaagtagcaccaggatttgaaatcagcgcacacacagcagactgtccggtagcagccgcagagaatgcaaaaaaaagtttatatgctatccagtatcatccagaagttcttcatacagtagaaggaacaaagatgttatctaacttcgtattaggcgtatgtggatgtgcaggcgactggaagatggatgcattcgtagagaacactgtaaaagaaattcgtgaaaaagttggtgatggacgagtattacttgccttatctggtggagtagattcctccgtagcagccggcttattatcaagagccatcggaaagcagttaacctgtgtattcgtagaccacggccttcttcgtaaagacgaaggtgacgaagtagaaagtgtattcggaccggaaggacagttcgacttaaacttcattcgtgttaatgcacagcagagatactacgataagttagcaggcgtaacggaaccagaagcaaaacgtaagataatcggagaagaattcatccgtattttcgaagaagaagccaagaagatcggtgcagtagacttcctcgcacagggaaccatttacccagacgttgtagaaagtggtcttggcggtgaatccgcagtgattaagtcccaccacaacgtaggaggacttcctgattacgttgatttcaaggaaatcatcgagccacttcgtgatctcttcaaagacgaagtacgaaaagcaggtctggaactcggaatccctgaaaagttagtattccgtcagccattcccaggtccaggactcggaatccgaatcattggcgaagtaaccgcagaaaaagtacagatcgttcaggatgccgatgccatctaccgtgaagaaatcgcaaatgcaggtcttgaccaggaaatcaatcagtactttgccgcactcacaaacatgcgctccgttggcgtaatgggcgacgagagaacctacgattacgcagtagcacttcgtgccgtaaagaccatcgacttcatgactgcagaatccgctgagttaccatacgaagtccttaataaagttatgaaccgaattatcaatgaggttaagggagtcaatcgagtattctatgatttgacgagcaaaccaccgggaacgatagagtttgaatagtaccaaaatgccgaagagccgcttagatagcggctctttattttgttcgtctataaaatgtctatattattccagtagttttgtgtgaaaaagtaatattagttaattatcatgtcatgagggccagtaatcttatttaaaaatttcttatttaattcgtctatttcttgatttggccatgaaccaattcgctctttaatatagataatatcatcccagtatctgtttaggttttcaagatatttccattgtgagctggctatttcataagttacatacaattcattatttttgcaagtaatttttctgttgatattcaaaccggctctttgcatagtttcaatttgacataggaattcagcgaaatatgacttgttagattcattattaattatatcctgtgttttaatagagataatgtgcatgtgatcatagtcaattttagtgctgacttcgggtgaaaaacgctttataggaatatctgcttctattaatttttttataagcagaataaattcagattcttttgtgatatccctatatacttttttactagctgcaagagcatctgccattgcagaatcaagttgtgatagttcggcctcaccttgcatttctgcatttaaagcatccatttgagcttgtaagtgattcattttcatttgattttgtaatttttttgtgttttcctcagcaacatttattggatattcatatctccatagagcatagttagcttcttttttttctttctcttttttagtatcgcttggattcggaagatgttgttggtacatctcataccattctttaagaaattcgtcaaaatcatgaggaaggatatcttgccctataacagtaggtccactgaattcaagatagtatttgttatttctttttataggatgtaaaccatgaaagtcttcaatatcgaataaagcgtgaaacatacgctgatatgggagcatatctgcatcaaataggcaatacacatcaatattcaaggcctcacatatgtctttgagtgttttctctcttggtatttttttgtttttttcatattgagcaattcgtacatctgcggatgaagcggaaaaaccacacatgatacctaattgtttttgggtaagtccccttaactcacgaattttttttatttttccgccgattgaaccaggagagataaagttatcattttcaaataatttcataatatcaaaagtcataaaatcaacctttcaaaaatagtttaatcttattataacaagaaatgaaaaatattaaactaaaaaaattggattaactaaaaaaattaagacttgacttaactgattagattagtatattatgaatgtacaaacctttaaggttgattattaaattcaagaaaggagaaagttatgacagaagaaagagtaccaatgtttgtaggagtcgatacagtcaaatttgatcttggagtatctagagccaaagcctatgaggtgataaagcaactgaataaggaaatgaaagaacagaatccaagagcgattgtagtatcaggaaaggttaatcgaatctggtatgaggaggcgtgtttgaaatctggtgttcattaataagaaagacagaaataattagaaaagaaaaagcccctcggcaaaggggctgcacatgttattactaacatgaatgtgctgagtaaatgttagcatggcaggtgcttcttttcaagaaaaatcttagataaggagtttttgaatggcagttttaaaaaataaaactcaaaaaaattttacaataattagtaataatgttttgagagataaagagctttctatgaaagatagaggagttttatgtacaatatgcagtttgccagatgaatggaaatttagcatatcgggcttaagtgctattgttccagatggtgtagacgctataagaaaatctatttttaatttagaatcactgggatatgtagtgcgtaaaaagactcggggaaaagatggaaagtatgttagcgaaatagaagtttttactgaaaagaggaatgtgatagatttaccgccacgggaaatccgtcacggtgaatccattacagataattcgacatggaaaaaccaatacggaaatgccatcgcggaaaaaacactgcaatataataaggataataagagcaaagaaataaaaacagataatataaaatctatccatctatctggaaaatcagaagtagaagaggatgtggagcgagagatagatatttataaatacaaagaaataattgcagataatataaggcttagttggcttatagaaattgcagaacgtcataatgaagatgaggtcataatggtacatgagatttatgatgtcatttgcgatatggtttgctatccaagagataaagttttagtgaaaggtacgttttatccatgggaagaagtgaaatctcgtttcttaaaattacgatatgaacatatagcggacattttaaacagacttatagatgcgactcttgaaataaaaaatatgtcctcctatttgatttctactttgtacatagagagtcttgtgggtacattagatattcaagctagattacacgatgattatacaaaattcctgagaggaaagccatatttaaattatgggaaggagaaggtaggatatggcggtatataaagacaaatggaatggatataaaggaacgacatggcgtgttgcttgttactacaaagactggaaaggcgtgcgtagaaaacatgagaaaagaggattttctactaaaaaagaagcattgaagtatgaacgtgaatttttggcaaagaccagtaaagatattaatatgggatttggtgcttttattgatatctatatgggagatttacgaccacagttaaaagctagtactatggataataaagaaaatatcatagaagcacatattctaccatattttaaggatagaagcttgtcagaaattacttctgttgatgttttacaatggcaaaatgagctattaagtcaaagggatgagaacggaaaagggtattcacagacttatcttagaagtattcagaaccagttaaatgcaatatttaatcatgcagtcaaatattatgaactgccgagaaatccatgtatagctaataagaaaatgggaagggcaaaaggaaaagagatgcaattttggacattagatgaatatcttaaattttctgaagctattaaagataaaccgatttcatattatgcatttcaaattttatattggacaggaattcgatgtggagatgatgatgataaaataagactaaatcaacggaaacccagtaaatacaaggggttgagtcgatttggtcctgaaaaaaacttgcaacgaatcaacaaatttatgaaggaaaggcctatcttttataaaaaccttattcagatgaaagaaaatttccgcttttatctgagatgcttttactgtatcacgaaagtggtgatattacaatttaatagtgaaaacaggaccgaattagctcgtaatggatgaaaatctgtttagctgattcggtcatttttattgattgaaaggtgatgaaaaaatggctagaattatttctattgtaaaccaaaaagggggaactggaaagtccgcatgtacagctaatttagctgtaggattagcacaaaagaataagaaagtgttaatcgttgatgccgatccacagtctgatgtatccgcaggatttggatatcgtgattgtgatgacagtaatgaaacacttacagctcttatggatgcagtaatgaaagatgaagatattccttccgactgttatatcagacatcaggcagagggaatagacattatctgttctaatattggactggcaggtacggaagtccagttggtaaatgcaatgagcagggaatatgtattgaaacagattttatatggtatcaaggatcaatatgatgcagtcatcatagattgtatgccatcattgggaatgattacgatcaatgcgctggctgcatcggatgaagtcctcattccggttgaagcgtcctacctaccaatcaaaggattgcaacaactgttaaaaacaatcggcaaggtccgtaagcagatcaatccgaagctacaagtaggaggtattttgtttacgatggtcgatgctcatacgaatgatgccagaaataatatggagcttctcagaaatgtatatggaagtcaaattcatatttttgataattatattccattttctgtaagaatgaaggaagcagtcagagaaggacagagtattttctcttatgatccgaaaggcaaagctacagaagcctatcggagagtggcggaggaggtgctgaaagatgccatctaaaaaaagagcaactaccatttccttacagccacttgatgcgttgtttggaacaaatgaagagacgaccaatggaattagtgagatagcaataggaagccttcatccatttccgaatcacccatttcaagtaaaagatgataagaaaatggaagaattatcagatagcattacacagtatggcgtgttggttcctggtattgtgcggttgagagagtccggtggttatgagcttgtagctggtcatcggcgaaaacgagcatgtgaacttgcaggattagagaaaatgcctgttatcatcaaagatcttacagatgatgaagcgacggtgatcatggtagattccaacattcaacgagaagagctgctgatcagcgaaaaggcatttgcttataaaatgaaatatgaggcgttaaagcgtcaggggaaacggtctgatttaacttcttgccaagttggcaagaagttggcggtggaagaagtcagtcagaatacaggagatagttccagacagattcttcgatatattcatctgacagagttaatcacagagcttttagaactggcagacgagaagaagcttccctttaatacagctgttgaagtttcatatttgagaagtgaagaacaacagatattgcttcagtatatgagtaatcacaatatggtaccgtccatgaagcaggcaaaggaattgaagcagatttcaaaagagcggatgttgacgtattcagagattgaccagatctgtatgaatgagagtactgagaaagtacaggtgcagattcctgcgaaaaagctgaaacagtattttcctgagtcatattctaaagctcagatggaagaagtgatatttatgctcctagcatcatgggcagaaaaacaataatatgatatgaaaagttggacagaaggaatgaaaagatgatgatagaagatgtaattaaaaaatcaatattgccactggcatttatgctattctggttctggatggtatttaccatcatgaaagtcagtggacagacagaattgttctggtggatatttctttccggacttccatttggaatacataaaatgcggctgattctaatccctagaggaatggataccacagcaacacttggtatggctgcattaagtgtcatcattggagcattgattggaagtatcatgattccagtgtatgtgattagagcgatatacgtgtttatacggtatgtcattggaaaatagaatattagattgataagaggcaggcttgcgaaaacaaaaatcgtaagtctgcctctttttttgtgcttaaaaccaggcaattcaggggaagtcccttttgcaaatatatattcttggaggatttttaagatgagagagcgaattgaaagtaagcatgtaactaaggaaatcaaaagtcagatgccagtgattccggtggaaattgttaaagaaagaggctgtacgttctgcccgtattatctgggcaattatgagaaacagccacgttgtatgatgaaaacctgtgcctgggatgatgaaaatgaacgtttccatccagttcttcgtgaactgatcccattttacaaagagaagatggaaaaagcagaagaaaagttccttgcaatgaaaaagatttatacaacactgttaggaatgtttgccgatgaaatgaagcaagaagagttggaaaaagatgaatgttacggatgtgcctatggaaaatgtggaccatgtatcggcatctgttacaaatcaatgaaagcataggagggttaagccaatgaatacaacagttatttccgggcgattggtaagaaatcccggatacaacgaagtggagaatgaaaaaggacttcataagattgccaagtttgttctggcagtcagaagaaattattccgatgaagtcagtttcattccggtaaaggcttttgcaaagaaagcagaatttgccagagattatctgatgcagggcacgaaggtcatggtggaaggcgagattgtcacaggtaattatgaagataaggataccgggaaaaagatttataccaccgaagtgtatgcaaaccggattgaattcgcaggtgcaaaaatggttgacagaccaccgtttccagaagatgcggaagggttcttagagatcccagagggcatggaagaagaaatgccgtttagatagaggaggataaaagatgggttcagtagatcaggcgtatatggtagggcatatgaaaaatgccgatggaagtatcaataacaaaaatgtagtgctgtcagcagcatgtgaagcagcggaactgttccagtgcatgatgtcagtaaatcagaaactggaggactggcagagatttaaccacaccttggagcagcatcttagaagtgtggaatgtgagaaaatccatgatatctgtcaggcagtatatggaatgaaacatccgtccgatgaactggaaggattgtatctggcaagagaggatgaacagatatgccttctgtactatcaggtatttgtagggatgttggaaatcaatattaattcagccgaagtgctgtacaaacagaaggaggaaacaatcaatgagtaagatggagtatatgctggtagattgtctgcaggtgccgaaggtgctgttccagatggaaaaatacaaaaatctgtcaaatacagcaaagattttatacagcttatttctggatcgtttgaaatttgcggtgcagaatggttgggtagatggtaagggggatttgtatgtaatttatccaaaaagtgaaatgaagaaagacctgaatacaaccagatatggggtagatcaggcagtacaggaactggtggaggttggaaatctggtgcgtatcattccgaacaatggaaaggcaaaccacttttatatcaacgatatttatgaaaatgagatggaggaagaatcaatgatgacattagacagcattatggcaaatatgccgatggaagaaagagaaatcattatggacaaaatggtgaaagcatccagagatattctggaaacaattgcagatatgggatatctgtatgaatatgagacaccactgacttcaatggaagaaagaaattatcgagatgagctgggacagcttgctgttgatcagatttcctgcgatggctatgaatttggcatgaatctggcgttcggaattcttgaagagaatgaggaaaatgctgatagagtactggatattcagaaatatgtgaacaggcagaataaaaagtgttcaaaaaagaaatttatgaaagttctggagactctggtacacgcaataggaaatgatgaaggatttattgccgatatgtatgcgtgtgataaagaggctagggaaatctatttggaagaagcgatgaatgcattcaattatgtgcttgatgaattatgtcatggtacaggaagtgcagcagggtatgacttcaataatatagaagaataggaaataatttatggcagattttgaatacttcagagcagaagaatctgaccagttttcttttttccggataccgaaagctctgtttaccgaaaaagaatttcagagtctttcaacagacgcaaaactcttgtatggaatcctgttagatcgtatcagtctttctaaaaaaaatggttggattgacggtgatggttatgtctatatcatttacacgattgcagaattgcaggagctgttgcgaatgtcgcatacaacagtaacaaagcttctttatgagcttgacagtgtgcatgggattggattgattgaacggtatcggcaggggaataatcgtccctctgtcatatacgtgaaaaattttgtgaaacggattagaggaaagcccgtaagatactttgcttctggaacgccagaaactggaaatccggactgcaaggaattggaaatccggattgcaagaaactggaagtccggaacgcaaaaaaatagaagtccggactgcaagaatctggatggaagtaatactaagataaataagactgaaaagaatcatactgataagagtaagagcaatactcccgctttggaagaaaaattcggtctgtatgggagatttaaaaatgttgttctgtcggaagctgaactgcaggagttgatgactctatttccatgggattatcagaaacggattgatcatctctctgtttatatgaaatccagtggaaaagagtatcagaatcattttgcaacaatctgtctttgggcagaacgagatggagccagggcaggaatggataaatatgagtttcaggaaggagaaagcctgtgatggaaaacaaagtaacagcagattatctggatgaagagggatgtcttcattgtggtatctgtggaaaaagaaaacagatgaaagttagtctgatgggatttgagcatgtagtgtcctgtttgtgtgaatgcgaggtaaaagccaggcaggaacttgatgagaagatgcagcgggaagaagcacagcggcagctttatcagagaaaatccgtcggacttcgggaaagaagattctgggaatggaaatttgaaaatgacaatggaagcaaccagaagatactaattgccaggcagtatgtagaaaactggacagatatgaagagaaaaaatgtaggattgcttctgatgggaccagttggaaccgggaagagtttttttgcaggctgtatagcaaatgcacttttggaacagggagaacgtgtcatgatgacaaatttttccagaatcttaaatgaaatgaccaactatcaggcagataggaaccagatcatacaaaatcttgtggattatccgctgctgattattgatgacttgggaatagaacgaaattccgagtttgccctggagcaggtctataatgtgatagacagccgttattgtaaaatgcttccgctgatcgtaacaacgaatctgggactgaatgaaatgaaatccacagatttggatactgcccatcagcgtatttacagtagaatacttgaaatgtgtgttcccatctattgtggtggagaagataagagaaaagaagaagggacagaaaaactcgtacaggtgcagaacctgattaccggttaatctgtcttttttcattaaagggggtgattgccatgattacagatctggacagcagttgaatcgctgaaaggagggaaaagtcatgcaggaagaggtaactcagaaaacggtcacgttttgtattcgggctactaagattacggcaaacctgttgaaaaaggttcttgttgcgtatctgcgtcatcagaagcagaaatcagtagagaagaaagcacagaaaaatcagccgaaacagggaaaggtcacggtaaaagagctggcaaaacagaatgccgggatggtcaatatcgagatcacaaataaaaatatcaagtcctttgaacggtatgccagaaaatacgggatcaattatgctctgaaaaaagacaagagcaaagagcctccggtttatctggtattcttcaagggacgtgatcaggatgcactcaatgctgctttccgtgagttttcccagaaacagattcaaaaagcgaataaaccttccattcataagcgtcttgcagcttaccgggcaatgatgccaaagaaatcgaaggacaaagtaaagaaccggcatcaggagcagagtcgatgaaaaagaaaagcggcaaaactctgatgcagaagtggaagaataaaatcgggggtaagctgtccgccctggataaaaagaaactggttcttacaaatattccttatgctctggctgctttctatgcagaccgggcattttttctttaccggaacagtccgggagaagatatggggaacaaactattatatgcaatggaacacgcagaccggatttttgctggttttgtgttaagcaataactggaaagatctgctagcaggtattgttgttgcagtcgttctgaaagtgttggtctggcagaaacaggcagacgcaaagaaattacggaaaggcatcgagtatggttcagccagatggggaaccgcagaggatatcaagccttatatgtcggaagatccatggatgaacattccattgacagcaacagaagcactgaccatggagagcagaccgaagcagccgaagtatgcaagaaataaaaatatagtggtcatcggcggcagtggttccggtaagacacgttttttcgtaaaaccatcggtcatgcagatgaactgttccatggtcattacagatccgaaaggcactttgattgaagagtgtgggaagatgttagcaaagggaccacctaagaaagataagaatggaaatatcatgaaagataaatctggaaaagtggtacatgagccatatgtgattaaggttctgaataccatcaatttttccaaatcgcttcattacaatccatttgcttatatacggtctgaaaaagatatcctgaagctggttacaacaatcattgttaataccaaaggcgaaggggaaaaagcttccgaagatttttgggtgaaagcagagaaattgctgtacacagcattgattgcgtttatctggtacgaggggaaagaggaagaaaaaaatctcaacacccttctggatctgctgaatgaaagtgaaacccgtgaagaggatgaaacttaccagaatccggtggatatgttgtttgaagagctggaggcaaaagaacctcagcattttgcggtcagacaatataaaaaatacaaaatggcggctggaaagacagcgaaaagtattttgatatcctgtggagccagacttgccccatttgatatcgcagaacttcgtgagatcatgtcttacgatgaaatggaactggataagattggggacaggaaaacagccttgttcttgattatgtccgatacagatacaacctttaactttgtgattgcgatgctgcagtcacagcttttcaatttgctttgtgataaggcagacgatgtatatggtggaagacttccggtgcatgtgcgtgtcatcgctgatgagtttgccaacatcgggcagattccacagtttgacaagctaatcgcaaccatccgaagcagggaaatctctgcttctattattttgcagtcacagagccagttaaaggcaatgtacaaggatagtgcagataccattctgggcaactgtgatactacacttttccttggtggcaaagagaaaaccaccttaaaggaaatgagcgagcttctgggtaaggaaactattgacctgtataacacttcggagacgaggagtaatcagaaatcctttggactgaattaccagaaaacaggcaaacagctgatgacagaagatgagattgcagtcatggatggaggaaaatgtatcctgcagattcgtggtgccagaccatttttctcagacaaatatgatatcacgaaacacaaaaattatcggtttcttgcagatgaaaatgagaaaaaccgatacaaagtagaaaaagagttaaatccgcagtacacaccgaaacccgaagaagaggtggaggtaattcaggtggagctgtcggagtaaccttgggaatgaacgaaaaataatgaggaaaggaataactgacattaggtgcgccggctttttagtcggtgttttttcattcccgtaaacacctgaaagaagtcagttttggtgaatgtatatggcattttttagcagtgcaattacaactttaaaaactcttgtagtcgcaatcggcgcaggtcttggcgtgtggggtgtcgtaaaccttctggaaggatatggaaatgacaatcccggcgctaagagccagggcatcaaacagctgatggctggtgccggaatcatgctgctgggaactaccctgattccacagctggcaacattgttctcttaagaggagtggtagatgaacaccatcattgagagaattacggaagcgataaaggatatcctaatcgggcttattaagtcatgtttggataacatgttcacgtctgtcaatgagcaggtgggaaccatagccgggcaggtgggacagacaccgcagggatggaatgccggaatcttcaatctgatccagaacatttcccagacggtgatcgtccccattgcgggactgatcatcacatttgtcctgtgctatgagttgattacgatggtaacgcagaaaaataattttcatgaatttgagacttataacattttcctctggatcttcaaagcgtatgtagctatttatctggtgacaaatacgttcaatatcacgatggcggtctttgacgttgggcagcatgtggtcaacaatgccgccggggtgatatcaggaaacactgcggtggatgcatcggaagcaatcacaaggattgtggatgcactggaagacatggaactgggggatttgttcttgttatccatggaaacgctgttgatcagtattaccatgcggattctgtcaatcattataaccgttattttgtacggaagaatgatagaaatttacctttatacttccatagcaccaattccgtttgccaccatgaccaataaggaatggggcaatatcggaaacaactatttaaaaggcttgttcgcactggcatttcagggattcttcatgatggtctgtgtgggaatttatgcagttttagtaaatgcaatgaccatatccagtgaccttcatgcagcaatgttttcagtagcggcttataccgtgattcttgcattttcattattcaagaccggaagccttagcaaatcaatattcaatgcccattaacgggcaggaaaggagcgcataccatggcgtatgtaccagtaccaaaagaccttaccaaggtcaaaacaaaagtagcgttaaatctgacaaagcggcagctgattttcttttcacttgccgcagttgtggggattccgttttatctggtcatgagaaaaccaatcggttccagtatcgcagccatcctgatggtaacgatcatgcttccatttttcttcatggcaatgtatgaaaaagacggtcttccctttgaaaaagtggtggcaaatatcattcgacagaagtttatctgtccggcagtaagaccatataagacagaaaatttttatcaggagatttccacccttgtgaaaaaggagggtgtgccggatggcaaaaaagacaaagcaggaggctcagcaggagcgtctgtccctggcggaaaaaagaaaccgtcaggaaagaagaaacaaaaaaagcagaaaagaaagagaacaggaaaagcgtagaaagaagcaggaacgggatcgtaggaaacagaaaaacattcctacaactgcacagcagagtattccgtatattcggatgctgcaggatggtatttgccaggtgacaaagacctttttctccaagacgattcagttttatgacatcaactatcagcttgctttaaatgaggataagaccacgatatttgaaaattactgtgatttcttaaattactttgattcttccatcagtgtgcagctgtcctttatcaatcagcaggtggatgtggcagaatttgagaaaagcattgacattccggatcagaacgatgacttcaatgccattcgtgaagaataccgtaccatgttgaagaatcagctttccaagggaaataatggtctggtaaagacaaagtatatcacttttggaatcgaggcggaaagcctgaaagtggcaagaccaaggcttgaaagaatcgaaacagatatcttaaacaactttaaggtcctgggagcacaggcacattccctgaatggtctggaaaggctggagattctgtatcatgtgttcaaccaggatcgcattgaaccatttaagttccagtataagatgctgccggaaaccggattaaagaccaaagattttattgcaccgacttcctttaacttttccaagaatcagacatttttgatgggaagaacgatggggagtgtgagttacctgcagattcttgcaccggagctgacagaccggatgcttgcagacttcctggatgtggatgacagcatcaatgttaacattcatatccagtccattgaccagagttctgcgatcaagatgatcaagagtaagatttcagatctggataagatgaagattgaagagcagaagcgagcagtacgttccggttatgatatggacgtgcttccatcggaccttgtgacttatggagaagaggcgaagaacctgttggaagatctgcagtctagaaatgagaggatgttccttgtaacggttctggtgatgaataccgcaaggaagcgtcagaaactggataacaatattttccaggtgcagggaattgcacagaaatataactgttctttaaaacaactggattatcagcaggaagcagcactcatgtcctgtattccactgggagtcaatcgaattgaaattcagagagggcttaccacatcttcaacagcgatcttcgtgccatttacgacacaggaactgtttcaggaaggggaagctctttattatggattgaatgcattatccaacaacatgatcatggttgatcggaaacgtttgaagaacccgaatggactgattcttggtacaccaggttccggtaagtccttctcagcaaagagagagattacgaactgtttcctaattacggaagacgatatcatcatctgcgatccagaagccgagtattctccattggtacaggcactgcatgggcaggtggtgaaggtttcaccggtatctgaccagtatatcaatccaatggatctgaacctgaattattccgaggaagataatccactgtcactgaaagcagattttattctgtctttgtgtgagttgattgttggaggaaagaatggactggagccggtagaaaagaccatcattgaccgttgtgtgcggttagtatatcaggaatatcttgccgatccaatgccggagaagatgccaatcctggaggatttatataatctgttgcggaaacaggaagagccggaagcacagcgtcttgcaacttcattggagatttatgttacaggctccctgaatgtatttaatcatcgcacaaatgtagatatcaacaatcgtatcgtttgttttgatatcaaagagcttggaaaacagctgaaaaagatcgggatgttgattgtgcaggaccaggtatggaaccgagtgactatcaatcgttccgctcataaatctacccgttactatgtggatgaattccatcttctattaaaagaagagcagacagcagcttacagtgtggaaatttggaagaggttccgtaaatggggaggtattccaactggtgaactggtttgttacttgttagtcgcttaaagtgcaaactatcgccgttctgactgaaaccggcaagtaagtcagaagtatcaatgcggaaaaaaacgggaaaggggtagcgacctaatccgagtggaaggctattcataatagaatagccacacgcaacgcatagagcttgaacctgcataagcagaatataacagctccaagaggccgcattgccagccggtacgatataatcgtggtaaaaagatatgctatgctgagcgtgaaatgacacgctgatgaaaatgggcgaaagtcccagagaggtggataaaaagccgcctgataataacaatcagataacacagaatatcaaagatttattggcttccagagaaatcgagaatatttttgaaaactctgatttcatttatatgctcaaccaggcttccggagacaggcagattctggcaaaacagctgaatatctcaccaacccagctgtcctatgtaaccaacagcaatgagggggaaggacttctgttctatggaaatgtcattatcccattcgtagacagatttccgaagaattccctctataaaatcatgacaacccgcttggaggaaacttctgaagcaggttaaatcaaaggagaaaataatgttacgagcaatttcatatgtattaacttttagtggcggtgctgtttttggcatcgcttttctctgtttattacaggcagggaaagggtatccgaagaaggaggagtaagtagtggcagaacagagaatgaaagtcagggataagaaagtccagaagatgaccaaggatggtctggtggaagaaaacctgacggataaatcttctgttcgtgtcagtaaccgtgccagtgatgtgcagatgggaggaaaacaaggggaaaaagaattaagccttgtggataagtcttcccgccagtctgaacggagtgggaaaaatattcgtccctctgtgcaaaaatccagagatgcaccggaactgatacggacagagaagcaaagtaaggattttggacaaaatagaaagcagcaaaaccggaaaaggattcgtgctgaagtcggaaaagaatccagacttgcagaaaaatctgaagccggacagtcagggagactgaaagaaaaacgtgctgatctatcagaaaacagaggagacagccggagaaatcagaccggcggcagcaaaaagccaaaacaaaaacagcgtttgaaatttgcttatgaggaaactggtgcttctgtgaaaaatgaaaaagatatggagaaattgaaccagatggatacggatggagtcaattttcgccatcaaaaacagaaggaaaaagccaaaaagttttcttatgaggaagcaaaaaagaaaaaggaagctaagcagcattccaagaaggcacaggtctatcgggcaaatgaaggggaagctcctggacagaagaaatcccgcttgaagtttggcgaaggggaatctgtgaaaacagaaaaaatttctgctgttaagaaagcaggaagtgcaacttccgtagcattgcaccgtgagatcagcaaaaatgaagacgataatgcggcggtagaaggtgcccataagttagaagaaggtggcgaaggtgtttaccggctggaacagagaagtgccagacgcaggaaacagagggcatccagaaaaagaagcagacttgaaagacaggaagagaaacaggcacaggctgcagcccatcaggagcagaagaagctgaaaaaacagattcagaagcaacagatcaaacgggattatgccaaagcgaagcgaagtgaacagacagtaggaacagctacaaaaggtacgattgattatattaagaagattggcggtaaggtcaccaacttctttaaagaaaaccggaaggtgtatatcagtgtagcagttctgatcggattgatgtttctgatcataacgaatgtcacgtcttgctctgcagtgtttttacaaaatgtgatcacttataccggaaccagttatctgtcatcggatcaggcaatccgggaagcggaactgtattacacacagctggaagctaatctgcaggagcggatcaacaacatggagtctgaagaaccgggacatgaggaataccgatataacatcgggcctattgagcatgatccgtttatcctgatcagttatctgtcagcaaagtatgaggagtttacttttgaacaggtcaagcctgaactggatgcattgtttgcagagcaatatcatctgactactgaagcagtcaatgagactgtgacagagacagcaacagtaagagttggagaatcgttgggacaggttgtaacaagcggatattgtaactgtccaatctgttgtggtatttggagcggaggcccgactgccagtggagtatacccaactgctaatcataccttagcggtagatgcttccaatccgtttgttccaatgggaacaaaggtggtcatgaatggtgtcgaatatacggtagaagataccggagctttcgcaagatacggtgtacagtttgacgtttactatgataatcatgcggcggcatccgcacatgggcataagacctgggaatgttatctggcagatgataatggaagccaggaagtggaagtgaccaggacaagagatgtagatgtgctgaatgtcaccttaaacagtggaaatctgatgttgatctgtcaggacaggctgagattttttcagaaagaactgttcagtgcctataacgatacgaaaggcaatttacagatgtttgcgacaccggttgattttaactggtattccagtgtgacaagttattatggatatcggattcatccaatttcaggagcaaatcagcttcataatggtatggatatcggagcaccggagggaacgaaagtaatggcagggctgaccggaacggttacaacttctgcttataacgatagctatggcaattatgttgtgattaaggacagtaaaggctatgaactgcggtatgcacatttaagcagccggagtgtatctgcaggtgcatccgtcacgaaaggtgatgagattggtcttgtaggaaatactggaaattctacaggaagccatcttcatattgaacttctgaaaaatggagagcgcttaaacccgatcttttatctggaaactggagaagggacaggctttggcggcaatgaatacaccagtgaagcggcacagcgtttgttgaacgaagcagcgagatatctgggaacaccgtatgtgtggggtggatattctccaagtggatttgattgttctggatttgtaagttactgcctgacaaactctggtgtaagaaatacaggaagattgactgcacagggactgtacaacatttgtacaccagtatcccagtcggaggcacagccgggagatttgattttctttactggaacttacgacgcaggggagccggtaacgcatatcggaatctatgtaggcaatggtcagatgatccattgtggacatccggtgcagtatacgtccatcaattctccatactggcagagccatttctatggatttggacgatggtaagaaaaaagggcggctgcatcagccgtccggaaaggagaagcgatgaaaagtcttgaaaaagcaacggcagattatgagaaagccaaggaaaaaatggaagcatccaaagccagatatgaagcagacttaaagcgtttcaaggctgcggagattgcaaaaacagaagcagaaaatctggaaattgtaaaaattatccgtgcaatggatatgagtattccggaattggaagctttcaaaaagagaatgaaaaatgaattgcccggcagggtagaaatacagaaggaggaaacaaaagccgatgatgaatctggaaaaaatgaaacagaagaagagaacaattactaaaagcagggtaaaaaagagcttgcttgcagcaacgacatttctttgcctgacaacacctttgctccagacacagactgcttatgcagctgagaataccacacctgcgattacgattgagaaaccggatggctggaaacagggtgaaacaaccattgctgttacggtagatgccagccatatgccggaaggtttctcaatagcaaagattgaagcaaaagcaggaaaagatggaagctggcaggatgtaaccggaagcggaagtatcacgatcactggaaaccagacagtgtatgtgcgtgtgacagatggtgaggggaaggtctatgagcagaatcgctctattaagtgttatgacacggaaaagccgacactctctgcttccctgacagatggtgtgctgacgattcaggggaatgatacagtatccgggattactgcggtaaccgtcaatggcaccacttatacagacttgaaggatggaatgctgagagtgcaactgacacagaaagattttactacaaaacagattgagattacggtaacagatggtgctggaaatacttctgaaaagtatgtgttgcagaatccttactatgaatgggcaaagaagcaggcagaaaaacagaaatcttccagggacagcaatggtgcaatggcaactacgaccagtgcagatgcaacggggactgagaaaacaacgacttctccgcttccgcaggatgcacaggcttctgagccgacagatgcaaaaggaaccgtggatgatcggacagtaacaggtattgaggaacagcttaataaagaaggcgagacggcagaagccgttaccaaaacagctacggaaggcacaaaagagttttataccatttcaacgaagagtggtaagattttctatttgattattgacaattcaaaatctcaggataatgtgtatttccttacagaagtcagtgagaaagatctgatgaacttcacactttctgattcagtgacacttccggaagtggatacggtttatgcagaaccagagaaaaaagcagaggaagaaaaaccggaaacgacagagacagatgagaaagataaggtggaggatgaaatccagatgccagaagataaaagcccatttggaacgtatcttctgattgcgctggtagcagtcggagctgcggcaggaggatattacttcaaagtctataaaccaaagcatgaatatgatgacgaggatgagatggaagaggatgaagatgaatccgaagattcagagtcagaaaaacgggaagtagacgatgcagatgagcaggaagaaagtgcagaaccggaaatcctgagagatgaagatttcaatgatgatgtactggaagatgaagaagaggagtaggagtaaatgaaattagtgattgcagaaaagccatcggttgcgatggcactggcttccgtgattggagccagaacaagaaaagatggctacgtggaaggaaacggttatctcgtttcctggtgcgtaggacatctggttggattatgtgatgcatcagaatacgatgaaaaatataaaaaatggagatatgaagatctgccgattgtgccggaatgttggaaacacagggtattggaaggcacgaaaaagcagtttggaatcttgaaaaaactgatgcgagattccaaagtagatgaagtaatctgtgctacagatgccgggcgggaaggagaactaatcttccgtctggtgtatgagcaggcaggatgcaaaaagccgatgaagcggctctggatctcttccatggaggaacaggcaattaaagatggatttgcgtcattaaaagacggttcgtgttatgacagtctctatcagtcagcactttgcagggcaaaggcagactggctggtgggaatcaatgcgagccgtcttttttccgttctgtataaccagaatctgaaagttggaagagtacagacaccaacacttgccatgatcgtggatcgaaatcagaagatcaaggaatttaccaaagaaaaatattatatggctcatatcaagtttgacgagatggatgcggtcacagagcattttcagaaaaaagaagatgcagatagagtggctgcggactgtatggagcgtatgtgcgaagtggaaaaggatgatgtgaaagaaaaaacggtccgtcctccgaagctctatgatttgaccactctgcagagggaagcaaacagaatgtttggttataccgcacagcagacattggatgccgtgcaggagatgtatgagcagaagctggtcacttatccgagaacagacagccagtatctgacagatgagatgggagaaagcactgaaacactgattcagatgttacttgggaaaatgccttatgctgaaggtctggaatatcacccagacgtgagtaaggtattaaattcaaagaaagtatccgatcaccatgcgattattccaaccatggaagtagccaaagcagatattggtgaactgaaagaacgaaaccgcaagattttgtatctgatcagtgccagggttctgacagcaactgcagatccttatatttatgaaagccataaatgccagatcacctgcaattatcatacgttttatctcacagcaaagaaaacaaagcaggaaggattcaaggcgatcgaaaataaattgaaacagttctttggcgtaaagattgagaaagaagagccggagctggatatctgggcaggcaagcattatggtccctgtgattctttggtatcggagcatttcacacagccaccgaaacagtacacagaagataccctgctttctgcgatggaacgtgcagggaatgaagaactgaccgaagatacagaaaagaaaggacttggtactccggcaacaagggcagcaatcattgaaaaactgattcagtctggttttgtgaaaagggaaaagaaaaatctggtgccgacagatgatggtaatgtattgattacagttctgccagatgagattaaatctccgaagatgaccgcagagtgggaaatggcattgaatcacattgcccagaatacagagacagcagatgaattcctaaatgggattacagaactgatgcaggaactggttgccaggtatcagggaatttcagaagaaaagaaaaatcagtttcagggaaaggcaaaaggagaagtcattggcaaatgtccccgatgtggagcagatgtccaggaagggaaagtaaacttttactgttctgaccggaactgtacttttaccttatggaagaatgataaattccttgcgagtcagggaaaaaagatggataagacggcagcaaagaagttcctgtctaaaggaaaaatccattataaggatctggtatcaagaaaaacagggagacagtacgaagcaactgtggagatggttgatcccggagagggaaatgtacagttcaatctgagtttcccgcaacgataagcagtgtattgcaggcagtctaaggactgtctgttttatgtgaaaatagtgattgttcagagccgcattcgccaaattgctgaaacagcaatttttgctcatgtggcgtatccgccaaataaaatttcaaaatcagccttagaaatgcaagcatttcacatctgatttatgaaattttgcttggctctgaacaattgccacaaatatatgaaagagaggaccttagcatgaagaaaaaaggtaattttagaaaagtagtatctggcttgctggcaggcatgacaatgcttagtacagtgctgtctccgatgacggcatatgcagcggagatccagccagaggagaaacctccactttatgaggaagtgaaagaccttctggatgaagatgaggtggtgactgccaaagattatgaaatcgaaacaggcagtgtatttaatgtgaaatcagattataccggactggaaatcaaggatgataacaaggttaaagtcacatttgaggaagcaaagaatgataagaatgaggattttacgacagatcatgcggacacttacaaagcggtctattatgtggaaccggtaaatcaggagcatccgaagtaccagatcagccgaaagctgattgtgcgtgagaaagaaacagaagtgcagacagaaactgaagggagtgaagcagtaaccgaatcagaaacagctggcagtgaacagcagacagaggaaacggagaattcagaagcagactcggaattgcttccaacagaggaagtgacggaaagcgagatagaagaatttgattctcaggcaagcgaactattaccggatatggaagaagatactgaaaatacaacggattcggaaacaggtcttacagtatcggatgcaatggagcaggcggaagaggaaggaattgatttatacgccatggaagctggtgaaacagtcacttttatggcaaagacaagtgcaagaagtgtacagaaagtatctgttacaagaggaactctgtatcgttatgcggattatggttatggttcttatcttacctatcagtatacggttcagtttggaaatgtatctgcgactgcttactgtgtacagccatcaaaaccgggaccaggaacaggtaattacacgattagtaaagtcggagatggaaaaacattagctaaggtatgttattacggaaccaaggcagcaggagatgaaggattctttacagaagagaatggttatggaaatcttagtgctggagcaaaattcattcttgttcatctggcggcttcttatgctaatggaagtggcgacgctttttccggagcgaatagtacagccaagaatttagcaatgaaattgtataattattgtgtttcacagccagaaataccggatgtagcaatgtcattttctgatggagatgtaaaagcttatgtggatggcaattcacagagaaccaaagatattacattcaaagcagataagctacagacaattacgatgaagcttccgtctggtgtgaaacttcataatctaagcacaggcacaacaagtaaagctggtgcaagtgtagaaatttgcggaggaacaaagttttatctttctgcaccactgacacaggtgagtgacgtggcacagagctggtcttctacaatgaagggaagtattacaaaagattactctgcttataaaatcaccaccggatctgacacgcaggatcttgcgttggtatttggtgaaggtgtgacagatgaaaaatatattgatttcaaagtgtcttggattgaacaggctacgatcgaaatcgtaaagaaagacgatacagcggatgtcaatcttgcaggtgcagtattcggtgtatacagcgatgaggcttgtacaaagctgatcactcagatgccggcaacagataaaaatggaaaatcctctgttacgatcattaagacacaggataccgtttatctgaaagagatcacagcaccacagggatatgtggtaaatgcaacggcaacaaatgtgaaactggtagcaagtaagatctcggctgtgaccgtggaaaacaaggaacagctggcagaacttaccatttataaagaaggacaggttctgacaggagcagaggtcagtgagagcggaactgtatttcagtatgaaaaccgtagacagaaaaatgctgtttataacgtgtatgccggagcggatatcgttactgcttatggcacaaaagtgtacagcaaaggtgatctggtaaaagagaacctgactaccggagagaatggttctgttacactgaagaacctgcatcttggaacctacgtggtaaaagaaacaaaagcaccagacaatttctataacggcagcgaagaaaagtcagtgactctaacttatgctggtcagaacaaagaagttgtatttgcagatgtgacttttaacaacgagagacaaaaagcagatgtttccgtagttaaacaggataaagacaccaagaaaccactgaaaggcggtatttttgctctgtatgcatccgatgatattagaaatgcagacggaaccgttattgtgaaaaaaggaacactgattgagaaagcaactactggcgaagatggaactgcaaaattcacagcagatcttccgattggatattcctattctgtaaaagaagatcaggcgccggaaggctatgtaagaaatacagaagatgtgtatacgtttaagttttcttataccaatgataaagaagcaaccgtatcatttgcccataccttcagcaatgaccgtgtgacagcaaagatcaatttattcaaagttgataaagagacaggaaaagcagtaccacagggagatgccacactgaaaggtgcagtttatggtctgtatgcccgtgaagatatcgtgcatccggatggagcaactggaactatttataaagcaggagaacaggtagcttctcttacaacagatgacaaaggacaggcttctgtaaatggcttatatcttggcaaatattatgtcaaagagatcacaccgccgaccggatacctggcagatacagaagagcatgatcttacgtgcagttatgaaggagatatgacagcagaagtaaaaagagagtgcacttccagtgagcaggtcatcaagcagccattccagatcatcaaagcagctaacaatggaaagacagatgcagatctgttattcggagctggatttacagtttatctgaaatcttcccttacaaagaaagcagatggaagctatgattttgattctgccaaaccggtagtgagtggagaaaatggagcaacggagattttcacagatgaaaaaggatatgcctgcagtattccattaccatttggaagctatatcgtgcgtgaaactacaacaccgcacaattacaagccggtcgatgattttgaagtgaatatcacagagcatcatccaaatgagccgcagatctggcgtgtgcttctggatgaagagtttaaggcaaaactgaaaatcgtgaaaaaagacgatgaaacaaagaaatccgtactgattgcaggaacagaatttaaagtgtacgaccttgacaacaaaaagtacgtggaacaggtaacaacttacccagtgacaaccactcacaagtcttattttacggacagtcagggatatctgatcatgccgaagaatctgaagatcggacattaccggattgaggaagtcaatgcaccggaagggtacacaatcaacaagaactatgtagagattgcagtggatgcaaacacagcataccagatggattctgagagcggagatgccattattacggtagattacgagaaccatacagtaaaaggaaagctgacaatctataaaaaaggtgagatgctgaccggattcaaaaaggattttgtttatgaagaaagatacctgaaaggtgcatcatttaatgtctatgccgctgaaaatatctatacaccggattatcagaaagatgaaaacggaaacagacagctgatctatgcgaaggatgcactggtaacaactgttacgactggggaagacggaaaagcagttgcagagaatctgccgcttggttcttactatgtggtagaaaagactgcaccggaaggattcgttctaaaccatgatagatcagaagtcgcatttgtctatgccgatcaggatacacctgtgattgaacaggaagtgactgttggcgatgaccgacagaaagttgcaatccaggtagaaaaacaggatgcagagaatggtgcaaccgtagtaggggctgtctttggtatctataacaaagcggatattaaggcggatggaaaagtaatcgtgaaagcagacacactcttacaggaaatgacttctgataacgatggtcttgcagcatgtacgctggatctgccacttggacagtattatgtgaaggagttaaaagcaccggcgggatttgtatcctctgatgaagttctgaatctggatgcttcttaccagggacaggatgtgaagacagtaaaactgaaaacagtgaaaaagaaccagccgacaacagttgaaatcacaaaatctgatgtaacaacaggtgtggaactggatggggcaaaactcaccgttcttgataaagaaggaaatgttgtggatcagtggacttctgtaaaagatcagccacatgtgatcaaacgactgactgtgggtgaagaatacacccttcgagaggaaatggcaccgtatggatatctgaaaacgacggatgtgaagtttacgctggaagatactgccgagattcagaaagtagagatgaaagatgaagttccaacaggacttctgatcatcaacaaaaatggagaatttctggataaggtgacacttctggacaatgtaaaaggtactgtggagcatctctttgagtatgtaaccggaagccttacagatgtgacgttcgatgtatttgctgcggaagatattaaagcggcagatggtgtcagtgaagattatttcaaagcagatgaaaaagtgggaaccattaccacagattctaatggtattgcacagatgggagatctaccggctggcaagtactatgtgaaggaagtaaaaactgcccatggttatgtgctggataaagagccgagatatgttgatctttcctaccgtgatcaggacacaccagtcattacttatgatgagaaatggcagaatgcccgtcagaaagtaaaggttacggttgtgaagaaagaaaaagatacagaccgtgtccttgcaggtggtgtcttcggtctttataccagtgaagatatcaaaaatgcaaagggcgaggtactccttgagaaagacagtctgatcgagcagcgagtaacggatgaaaaagggcagattacttttacggcagatcttccggtagatggaaaatactatgtgaaagaaatctttgcgccggacggatttgttacaacagaagaagtacaggaatttacctttgaatatgccggagaagaccaggcagaagtaagctacgactttacttttgaaaatcagccaaccacagtggagctgtccaaaacagacctgacaacaggtaaagaacttccaggtgcacacctgaaagtaacggattcagatggcaatacagtagatgaatggacttctacggaagaatcccatgtgatcaaagaactggttgttggtaaggaatacaccatgacagagacaaaaccggcagatggatatgtcactgcagaaagtattgcctttacagtagagaatacagcagaaattcagaaagtagagatgaaagatgatgtgacaaaagtagagatcagtaagactgatatcacaggagaaactgagattccaggtgcgaaactgacgattctcgataaggatgatcaggtagtagagagctggacttccacagaggaagcacattatatcgaaaaactgccaatcggtaaatataccttacgtgaagagcaggcaccgaaaggatatcttctgacagccgatgtgacatttgaggtgaaagataccgaagaaatccagaaagtggctatgaaagatgatactgccaagggaaaagtgattctcaataagacagataaatcgtcaggagaaccactgaaaggggtagaatttgaacttcgtgacagcaaaggaaaagttctggaaaccttaaagacagatgctgccggtcatgcagaaagtaagctgtatgagattgccacatttaagaacggcaaatatgataccgctatcaagtattatctggtggaaacaaagacactggacggatacacactggatcagaccaagcatgaagtgacattcgcctattcagatgacagtacaccggttgtggaagttacctttaatctgacaaatgagaaaccggaagttccagaaacaccgaacacaccggatacaccacagtcccatgaagagacaaaggtatcaaacgcaccgaaaacaggtgacagcacgaatatctggctgccaatcctgcttcttgtaatctccacaggaggtatggcaggactttatatcagccggaaaaggaaaagcaaataaggaaactaaaaccaacggttatgattgggagcttctatgtgaggctccctttttcatacaaaaaaatcacagaaaggaacagaaaactatgatgaaagcaatggaaaaaagacaggaagcacgaaaaaaccaggagaaaactttaaagagaatgatggcttatcagaagaaagccgagcagatggtcagcagaaaaagaatgaaccatcacatgatcagaaaggggtaaaagcgtatgatgaacagaaaagaattttatgaatatgtcaaagacaatgtaaaggagtatctgccagagtcttataaggacgcagaaattaaacttcaggaagttgaaaagaataacggattgaagttgactggtatcacgattccaaacggagatcagagaatcgtaccgacagtctatctggattccctctaccaggaatatatccatggaaaagatgtagattcttgtgttggtgatgtagctgatatgcgtattgaggcacagggaaaagcagaattttttgatatgggagttccggatattctggattatgaaaagatgaaagacaaattacagatgagaatttgtgataaggaatggaataccgatcttcttgcagataaagtagtcacagaacacggagattttgcagcttattatgcagtaaatctggaggaaaatggagaagggatcagcagtattccggtaactgtttctctgatgaacgagtggggagtatctgccgaacagattcaagcggatgcgatggtggcagaccgaaaacgtggtgtcacacttatggatatgaatgagattatcaaatctatgatttttggtgaagaaccagaaaacctgctgaatgaaaaaatggatatggaagccatggaaaacccaatgttctgtctgacaaacaaagctaagatgaatggagcttccctgttactgcaggaagatattcgtaaacagattggggaatgcctgggaagtgattactttgtcatcccatcttccgttcatgaagtgttgattctccctgataacggaatttttcaggttccagaattaaatgcgatggtacaggaagtcaatgagacacaggtggaaagacaggaacagctttctgataaggttcagttctgtgataaaaagaccgcagtaatggaaaatgctgagcgtagggaagcacgtctggaaaaagaaaaagcagaagtaaaaggtggaatccatggaagattggagaaagccaaggcagagatcaaggcaaaagaggcagacaaagtgccaaagaataagtcaaaagagcttgccacagcattataaagagaaacaacgatgatattaaggggactgtgccaagcagtccctgattttatgaaaaggagtagcacatggcaaataaattatatgcaatggaacagctaacggaagaggtggcaaaagatgtagctgccagtccgcaggaatggatgcggttcctaaacactgcatccagactgtacaaatacacttttccagaacagcttttaatttatgcacagcgaccggaagcaactgccgtagcatccatggaaatctggaatcagaagatgtaccgctggatcaaaaagggatccaagggattgccttgattgacaatacttccggatcgaaaacaaaacttcggtatgtatttgatgtgcaggacacttataaagtgcggaatctgggaaaagatcctcagttatggaatcttccggtgaaaggagaacagctggttgcagattatctgcaggaacagttatcactggaagatacagaaggaggacttgctgaaagtctgcatcaggcagcgaaggagagtatgcaggaatggcttccagatgcattggaagaactgagactggacgtaacagggacatttttggaagaactggacgaacagaatcaggaagtcgaatttcgggaactgatgaccaatagtgtctggtatgtattactaaaccggtgtgggctggatgtacaggaatatctggatgcagaggattttcggcatattacggacttcaatcagctgaaagtattaggacatctgggaagtgcagtcaacgaaatcagcagaccagtcttgatgcagattggacgatatgttctgaaggatctggaaaatgacctgaaaacggttgcaaaagaaaaagaagtagtttataatgaatttaacacgttaattcgtgaaagcatagaggatagtacagaagatagagaagaaaataaggaggaagtagactatgagagagatcagttacagtcagaacggagaataccagattccggatatcagcctggaggagacgagagggacgatcgggaagtacggaatgatgaggaaagagtatctgagaaatcacaaggtagccaggttcaacattctgacactgcagaaccgtctggacagtcatctgatggagatcgacagtcaggcaagacagagagtagacaatctgatgaacgaacttttggagaaagatccggcaccggacaagatggcagacacaatggcgtggaccagacacatgaaccagatcaaagcacaggcagaggaactggtgatccaggagattatttacagttaagcctgttcccaacagaagaggaacagttaggagaaataaggaaagcggcagctgcattagaacagccagccgcttttcttatttctgatgaaatggtagacgatattctccgaacaggaagcggacagaaaaatacgctgtttcacattactgcaagactgattgagggtctggacaatgaagaaatgcaaagtttcctgaaagatgaatatagaactggaggaaaaggatttaccatagatggtcagaaaatcagtatctggtacgacaacgatggtatccgtatccggagaggtgactctgcaagaagaaactttgaccgtattgttacgtgggaagaaaccgctgatcgaatccgagatatgtatgaggagggaaattacgttgataatctaatctctaataatgctatcgagcaggaacagaaagaaatgacagatcttctggcacttcatttccgagatacaaatagaaatacggaagaataccggtcttatacggattggcaggatatcattcggaatgcctggccagatccagaaggacaaaaagaaatctatcagcagtttgaatggttacaagcggatatgaatgaaaatccgagtaattatcatcgttgggaaattcagcacaatccagtgtattttcagcgttttcgtgacctccagagagatttttcctgggtggctcagcaattcaaggtagagcggccggcgctatcctttatcacacaggatgaaatagatgcagtgttaagaagaggcggcattactgccggaggacgtaaccggatttatgaatatttcatggagcaccatgatatgaaagatgcagctgagttcctgaaaaatgaatatggaacaggtggttcttcacccggaataccaggagcagatgcttctgacgcatcccacgatgcaaaaggattaaagcttggaaaagggaagattggcaatccagaggtagaagttttattaaagtggaataaggttgcggaacgtgtccgccagttaatccgcacagatgattatttgtcaccggaagaaatggaaaagtacgaagagcgacaggaagcacaaagactggcagacctggaagaagcacagcagatgttaggagaacagctggaacaagatacttttacagcggaagatataacggatctgcgactagttgattcagaatatatgtccggtaccagaacaaaaatctatgattttgattgcaaagttaagggagaagaggatcgacttcaatacactttagaatatcatgatgatggagaaggtttcacgattcatactgaaaaagatgatatttgggatcgaatgtcaacacaagaattggaacgtttggatgtaaaacttggacaagaagtactttattatcattatcacaataaaacagtaaatgcggataccttagataaattacgagatatcagggaagaaattatggaggaagagtcttcctattttactgctatttctaatcgtgtgtggacagattatgataaaaaagaaaaagaattatcaggagaaattgaggcatcggaagaaaaagaatcattggaagagattaacggaatagcagaacctattcaagcaacgaacttccatatcacagatgatgaacttggacagggaacaccgaaggagaaatttcgagccaatattatggctatccagttgttaaagaaatgtgaggatgagaaccgcaatgcaacaccagaggaacaggaaatcttatccaggtacgtcggctggggaggtcttgcagatgcatttgatgagacaaaatctgcatgggaaacagaatatctggaattaaagaccgtccttacaccggaagaatatgctgccgccagagcttccaccttaaatgctcattatacacagccgattgtgattgaaagtatgtatcaggtgttggagaatctgggatttacaaagggaaatattctggagccatctatgggagtcgggaacttctttggaatgcttccggagaatctaaaccagtccaaactctatggtgtggaactggacagcatcagtggcagaattgcaaaactgctctatccagatgccagtattctgatcaaaggctttgagaagacagattatcccaatgatttctttgatgtggcgattggaaatgtgccatttggtgcatacaaggtcaatgaccgtcaatatgaccgctacaattttatgattcatgattactttcttgccaaaacgatagatcagttacgtccaggtggtgtggctgcattgatcacaacaaagggaaccatggataaggcatcaccggaagtccggaaatatttggcagagcgtgcagacttgctgggggcaatccgactgccgaacacagcttttaaagcaaatgcgggaacagaagtcagtacggatattttgtttttccagaagcgtgagagtttcacaaaagagatgccagactggatagatttggagagtgatgcaaatggaattagcattaataagtattttgttcagcatccggaaatgattcttggtgagatgaaagaagtgtccggtccgtatggtatggaaacaacctgtgctccaatggaaggagctgatctggaattacagttacaagaagctgtaaaacacatcaagggaagcatggcaccggcaatagatgtggaggcagaactggatgagatgccagagagtattccggcagatccaaatgtccgaaattacagctatactgtggtagatgctcaggtatattaccgtgtcaattctttgatgaatcaggtgaaaatgcctgcagccactgcagaacgtgtaaaaggtatggttgcaattcgtgataccgttcgtgagctgatcgccatgcagatggaagaatttgtaacagacgaagaaatccagaaacagcaggaaaaactgaatcaggtgtatgatacctacacagcaaagtatggagttattggaagtaatgctaacaaacgggcattttctgatgactcttcttattgtctgctgtgttccctggaagacttgaatgaagatggaacattgaagcggaaagcggacatgttcaccaaacgaaccattaaaaaggcagtcgctgtaacaagtgtggagacagccacagaagcacttgctttgtccctaaatgaaaaggctaaagtagatctcccatatatggcacagttgaccggaaagaccgaagagaaaatcacagaagagctggttggagttattttcaaaaatccactgacagaccagtgggaaagcggagatgaatatctctctggaaacgtcagggataaattaaacactgcgagaacttttgcagagaatcatccagaattcacaccgaatgtccgtgcattggaggcagttcagccgagaaatctggaagcatccgagattgaggtgcgtgttggagccacctggattgaaccttcggattatcaggattttatggtggaactgcttcatacgccgaggtatcttgcacagaaggaaatacaggtaaaattctctgaggtaaatggtgagtggaggattacaggaaagaatgccgatagtccaagaaatgcgtttgcctatgcaacgtatggaacggagagagcaaatgcctaccggattctggaagataccttgaatctaaaagatgtacgaatctatgataaagtcgtaaatgacaatggggatgaagtgcgagttttgaataaaaaagaaactatgttggcctcacaaaagcaggatgccttgaaggttgcattccaagattggattttcaaggatcagcagaggagagaaaggctggtaagcgtgtacaatgagcgtttcaatagtattcgtccccgtgaatatgatggtagtcacttgagttttccaggaatgaacccggaaatagaacttcgtccgcatcagaaaaatgcagttgcacaccagctatacggtgagaatgtgcttctggcacatgtagtaggagctgggaagacttacgaaatggtagcggcggcaatggagagtaaacgtttgggattatctcagaaaaacctctttgtagttccaaaccatttgacggagcagtggggagcagaattcctgcagttatatcctggtgccaatattctggtcgcaacgaaaaaggattttgaacctgcaaaccgaaagaagttctgtgccagaatcgctatggggaattacgatgctgttatcattggtcactcccagtttgagcgtattccaatctctgatgagagacaggaagccatgcttcagaggcagattgatgatctggaaatggcaatccagagtgcaaggtatgaacaggatggtggacgttataccgtcaaacagattgaaaagacaagaaaaacattgcagacaaggctggagaaactaaatcagaaagagaaaaaagatcaggtagttacgtttgaagaactgggagtggatcacttgtatgtagatgaagcacacagctataaaaatgcctttctttatacaaaaatgagaaacgtagccggaattgcacagaacgaagcacagaaatctgcagatatgttcaataaatgccagtatctggacgagattaccggagggaaaggcattacctttgctacgggcacaccgatcagcaatagtatgacggaattgtatgttatgcaacggtatctgcagaatagtaaattgcaaaatatgggacttggattgtttgattcctgggcctccacctttggcgaggtagtcaccagcattgagcttgcaccggaaggaacaggttatcgtgcaaagtcaaggtttgcaagattttataatattccggagttgatgaatatgtttaaggagattgcagatatcaagacttccgatcagttagagcttcctgtgccggaagcggaatatgaaacagtggtgctgaaaccaacggaacagcagaaagaaatcgtagaaaatctgggagaacgtgcagaagttgtcagaaacggcggggtagatgcctcggttgataatatgctgaaaatcaccaatgatggaagaaaattagcattggatcagcgtttggtgaacgaattattgccagataatccagaaagcaaaatatcagtctgtgcagagaaaagctatgagatctggaaagacacagcagcacagaaatcggcacagctgattttttgtgacttgagcacaccgaaaggtgatggcagtttcaatgtttatgacaacttgaagcagaaactgatggaaaaaggtgtaccggaaaaagagattgcattcattcatgatgcaaatacagaagcaaagaagacggagttgtttggaaaagtgaaatccgggcaggttcgttttttgattggttcgacagcaaagatgggtgccgggaccaacgtgcaggatcgtctgattgcattgcatcatctggatattggctggaaaccatctgacttggaacgtgcgcccgtaaaggcatcataataaatatacctttggcaaggtattaggatagtatcttacagtcctatcatcaaccgatttacctgtgagggaaactaaatatcagggaaaatagcacgtcggtaaagccataagtcagctaattaccaagctgcgactgaatggggagatgaaaagttaggtatgaggataaagcccatactggttgaacgatagtccaaacggtcaatgtcgggactatggcgtaaggtaattattattcgctatatctcagcacttatgttccgctgttcaggagcgtaagcaaagataggctgagacgtatatgcaataagcataaaaggatggaagtcgtatccgacaacctaacaagccaaatcgttagtatgatgctaaacggggattacctaagtcgaaacgcttaaaaataagctattaagtgtaggcttatgaatattcgatatggtaacggagccttcatagtagtccgagagtgttaatggcacttacatggcgaaggaaggcagtttataacattaacaatatagaaaggataatgtgtgatacattatgagaaatcctgaaaatgtgttaatcagcttaacgaaacacagtaaccaaaaagattacaagtacgagcgtttataccgtttgctctacaatgaggaactgtacttaaccgcttatcaaaacatttattccaatgacggaagtatgacaaaaggtactgacaagcaaacggttgacggtatgagtatcgaaagaatacggaaaatcatagtttcgctcaaagatgaaagctatcagccaaaacctgcaagaagaacctatattccaaagaagaacggaaaaatgcgtccactcggaataccgtcctttgaggataaattgcttcaagaggttatcagaatgattttagaagctatctatgaggggcattttgaaaatacttctcatgggttcagacctaatagaagctgtcatacggcactcaatgaaattcaaaaaactttcacgggtgtgaaatggtttatcgaaggagacattaaaggtttttttgataacatcaaccatgctacgttgattggaattttacgagaacgtatcaatgacgagagatttcttcgactggtaagaaaatttctgaatgcaggctatattgagaattggacttttcataacacctattcgggaacaccgcagggtggcattatcagtcctattcttgcaaacatttatttggataaatttgataagtatgtaaatgagtatgtccgaaaatttaaaaaaggtaaaaagcgtatgcgtacaaaagagtaccgcaggaacgaagtcgaattaagcaaagccagaatcgcattgaaaaatgcaaacgacgactgtgaaagagaaaatgcgattgcacgcataaggcagttggaaaaagaacgggtgaatattcccccaagtgaccctatggataacaattatgcaaggctggtctatgtcagatatgctgatgattggctgtgcggagttatcggttcgaaagaggattgtaagaaaataaaagaagattttaagaattttctcaaagaacaattacagttggagctatcagaagagaaaacgctgattaccaatgcccaaaaaagtgcgaaatttctcagttatgaaatcagagtacggcatagcaatctaaccaagagagataaaacaggcaagctcgttcgtaattacacgggcagaattgtactggaagtttcaagtgatacaatcaggaaacacttgattgatacaggtgctatgaagttaatctaccataatggaaaagaaatttggaaacccaaggcaatatacagattgaaaaactgtgatgatctggaaatactcgactactacaacagtatgatacgaggtttttacaattattactgtatagccaataacagctcaatcatcaacagctacaagtatattatggaatacagtatgtataaaacctacggcacaaaatacagaacatcaatttcaaaagtaatcggaaaattcagagcaggaaaagattttgctgtaaagttccgtaattccaaaggagttgagaaaatgcgagtgttttataacgagggttttaaacggcagaaaaaagcattccaatctaatgcagacttagttccaaatacaatcaaatatttcagcagtacaaagctaatcgacagaataaaagccagagaatgtgagctatgcggaaaaactaatactcccatagaaattcatcatgttcatcggcttaaagatttacaaggtaaaactttttgggaagctcttatgatagcgagaaatcgcaaaacaatagctttgtgtagagaatgtcataagaaattacactgtggacagttaaattgagtttataaatggagagccgtatacagtgagagttgtaagtacggttcgggggcgagtatttggaaacctaccatagcaatatggcaaggcgctgggtacttagcctacagagagaagggcgtatcatccgccagggaaaccataataaaaaggttcatatcttccgatatgtaacagaatccacattcgacagctacatgtggcagctgatcgagaataagcagaaattcatttctcagattatgaccagtaaagcacctgtgcgaagctgtgaagatgtggacgaagcggcactttcctatgcagaggtcaaggcactggcaaccggaaatccagcagtaaaagagaagatggcattggatgttgatgtggcaaaattaaaacttttaaaagccaaccacatgaataaccagtaccgcctggaagatgatattgcaaggaattttccacaacagattgcaaaactgacggagatcattgacagctacaaggcagacatcgctcattattcggagcataaaagcacagatccagagcagtttactatggagattagtggcaaagtgttcacagaaaagaaagaggcaggagcagcacttctggcggtatgtaaagatattaaagctgtagatgctgcgatggatatcggaaactatcagggattcaatatgaggattcagtttgatggatggagtaaagaatttattctatctgtcaaacatgaggctgtctcgaaagttcatcttggagcagatgcacttggaaatattactcgtatcaacaatctgttggatagttatccggagaagctttcagaagcacaacaaagactggaaacagtatatgaacagcttgcaaatgcaaaagaagaggttggaaagccatttccaaaagaagaggagttgaaccagaaactggagcgactgtcagagttaaatgcattgctcaatatggatgaacgggaagatgctgaagcagaggtatctgaatcagatgagaaagaagaaagatcggcacgtggttctatccatgaaaaactgcagatttataaagaaaagagtcagcgggaaagtgaaactggcaaggaaaacagaaaacgggacttcggtctggaataagtaaacaggaaagatggcataatctggcagaaagaatgttctgcctgttatgccattttttagaacacaggaggaatttgaatggcgggaaatatgataacaggaaaagaaacgcagaaaatgcaggaatatacgcaggaacggattgctcaggcagagcgtagagatatagaattttcaacagatgtaaaagaacagatttttgaatatgcgaatctgatcggcgaggaagagaaagttaggactttggtaagaaatctggcagatgcagtgagtcaggcagatcaagaaggtgtagaggatttgctggatgacgtaagaatggatattcaggaactgccggatccaaccataggtaagctggaattacgtgactatggatatacagcagaagatatggtgccacttagaaaagaagcagccttggattatcacagaatgggttctaagatttattgccttggaagtgatggcagtaaaggtgaatatgcgagtaaagaaatgatacaggcacacgacggtttgtttggaatggaatcgcagatgtgggaacggattaaggataacaacctggattatgcagaagaaaatttaggagcatttcaggagcctatgagtgtcattgagcaggaagaagcactgaaattatacgatgccggagcagatatctatctgatcactaatttttcatcacctatgtatgtcacagaacgcatggaaattgaacgaggaccggagcattatcagatgtctatgacagaactggagcgtttccgtaacctggaatgggaaatgcagaaatatccacagattcaatctttgaaagaagcaaacctgttgttaggaacaagaaggatatttggaatttatcagatccgggatgatttaccgggagaaaactatgcatttatgaatatgagttttattgaaagtcatggtatgcagataaaaaaagaagattataagctggtctatgttggtgaattatcaggaaatatgtcactggatgatatttttgaaaagttcaacattgacagaccggaagacttccgtgggcattccctgtctgtcagtgatatcatagttctgaatgacggggaaaaggtaactgctcattttgtagacagtatcagttttgaacagctggattctttcctgaatctggaagaacaggttcttagtgaactggcatatgaggtaggagaacgatattttgctattcagagaacagaagaaggatatgattattccttttatgatgaagatttccgcttgatggatggtggcatttatgagaatgatgaaatttctattgaagaagcggcggaggaacttttggaagacgaaggctggacgggagaacgcatccgtggggattatgatcagttgatggaaaaagtagaagaaatggatgaagctgtaatggcagagattcagaaaagccagggcgaatataagccattggcaaaggtagaggaactggaagaggcaaattataacatgattgataacgtccttaacaatatgccaccgaagaaagaaccatatctggaatactttgcggcagaatgcgatgagttccatgatatgggagcgtatgaaaaaagtaccgatgctaatcagattgctgcagtctatgaaaaatatagggagaatccaaaaacagcgtatctgggatgctcgatgggaattatttatcatgatccggaagacagttactatgatgaagctgaatttgcaattgtaaaaggaaatactgtgtttggaaatctgatggatgatgttcggttttatggggaacttgcattggtacgggaaggaattgagaaaattcatgaagcattacctgactataagtacgttccgatgcgggatgttcgagaagcaatgtatccagagaagatgaccacagaacagttagcagaggcactggatgagattgcagaagcgtttgatccatatgagtatcgggataatgtggagccgggagaaaatacggtacaggaagtaatgctggatttgcgaagtggaaatattcattactatgtttcttacttgaaagatattgtagacgaagaatgcgacttgtctgttcgtgcaggtgtattgattgaaaggctaaaagcctatgaaccggaacttccaaaagatatgcaaccaatggtgtatgtgaattattgtgagaaaagtgaactggggaatccaagatgccagaagttatctgatttggattccaaaaccatagaacaggacaaagtctggtatgctgatcgtgatccaaagactaacgaaccaaaaacgacagcacagatgttttttacagtatattatgctgagaagggcgacaagatgctgcatcattttcaaggtaagatagatattggtaccggaaacggcggtatcatcagtcagttaaagatgcagaatgaaatgaaattgacagatgaaagctggatcagctaccagcaaggaaaaggcaatgaagagtatcagaagtatatggaagatctgacagatatgcagaatcatgtactgccgtatctgcagagcttttgcagcctggaagaaaaaggtgtgaaggagagacgagaacagcaggtagcagagaaaaatgagagcagagaagctgtgccaagaactggcggtgaagcaaatatagcagttaaggatgcggggaaagctgaaagaaaggaaataacaggaaaagagaagaaaccgtcgatccatgaacgcttggaaatcaataagagaatcatccaggaaaaacagggaaaagatgagccggagagaggagatgatttgagtgtaaggatggtgtagtataagatagaatggagtcggaggtcacagataacaatgtggctttcggctttttgttttgaatgattatgcttcaaacttttatgtgataaacgtaacttgctgtgatattataaaaatgatataagcgaaaatgacttttgcggaaaggaaagtatctttatttttttatgtgtatgcttcctattgtggaaatgaatacttgcaaagttgataactaatatttttctgctattacaggtgcaataagaacatgtaatagcggaaatgaggaatagttacttgtagatagagaagtatattgcggataaaataacatctctatgtgaaaagcgtgatatcagtaaatgcagattatcgcaactgtcgggaatttcccagtcgtcactgggaagaatcatggcgcaggaaaacctgccgtcgctgatcacacttgaaaaatatgtacagctttgggcgtgacattatcgtagttttttcaggaagataattcagagaatctgacagaaaaacagaaagaagttctaggaatatggaacgatctgagtacaaatgagcaggaaacagtaatgtcaatgctgcgtggacttcggaagtagaagaacagttcgggtatatgtatcggctgttcttttttgtttttcgggcgttaaaacgataaatttttcttgtgtatagttgagcgttaaagtataataaaatcaattttttgcataagattagagctataataaggaaatcggcaaaccagatgaaagtctgggacgcaaagctacagggcctgtaaaatggcagccagatgcataaaatgaggtgcactgtctgtttggcagtgtttttttacggtgttatttcatagacgtaacaataatgattttatcaggaaagaatgagaaaaataaaagtatgaaaaaggcaaaacgatgactggcaacagtgggaaagaagaacggaggctccggcccggcacattggaaaataaaaaatatggaaaatagtatgataagtgaaaagccctgcgcaggaccggatgtgttctcgtggggcttttctgcgtctgataaagacaggttttttgcggatttctctaaaaacaggaaaactgtcaaaaaatatcatacatagatcaaaaagactatatatgggcgaccttttaaagacggtttatataaaatagaagaaaaaaaggtggttgattccgtggatataaaaacagcggtcatatatcggttaaacgatctgattaagcagaaagatatcacagtgaatgaagcggcggtgcgctcaggcgtcccgccttcaacactgaaaaatattttgtatggacaaagcaggaatgctggcgtagttacaattaaaaagatatgcgatggattggatattacaatacaggaattttttgaagatcccatcttcgcagatttggaaccggagttataggaacaggcaaataatcttaggattcagattctgcaagatggtttttttatgggaaagggttagaagaaactaacactggaggatgaatatgtgtaaaatagcaatttgcgacgatgataaagaatacagggagaaaataaagacggtcataaaaacggaagggattctgtcttcgaatgagatacggttttatgaatatgaatcaggaaaagaattattggaagatgcggatattttgcatgatctgatttttatggatatgcgtatgcctggattggatggaaataaaacagtactgaagctgagggaatataatgaagcagcaatattggtgttctgctccggctgttttgaaccgactcctgacagcattaatgttggacaaccgttccggtacatcatgaaggatctgcatgacagaagtctgaaaaaggaaatacctatgattttattaaaagtgaaattgtgctgtggagattcttccgtgacagttacatcggcgggaaggataatgcgcatccatacggaagacattttatatatctgtctggcgaaaaggggctgtacgatatacattgccagacagggaaagatagaagagatgcattgcaaggaatctttaagtgatctgtatgagtgtctggccggaaggggatttgagtatgcacacaacagctatattgtgaatttggcaaaagtggaaggattggaaaagaacgttgcgttgctgtcgtttggaatccagttgaatgtttcgaggtcgagaaaaggacagtttgccgacgcactgataacatttcttggggaaaggaacggcatggtatgataataagagattatttgatttgtcttcttcagatgtatctgttggaggacttggaaaagaacatactcccatacagaagagaaagattctgggaaaaatttctcgtatattgtatcgcagcactggcaatgttcggaaccaaccgcctggaatcctcaatacttaatatggtaatgattccggtaatctatatgatcgcgtctatggttgtgttccggggaaatatatggaagaagctggttacggtatgctgctattatgtgctggcaattattcccgaatttctctttgcggcacttacgaatgcatatggcgtgactggtgcgtccgagggcttcaggactgaaacagaaaagacattagcactcctgctgatgagtaccatgacatttctgtttattaaatgcattaatcaggtaacaaggaaaagggattatctgacgattgaaaataaaacatttacagtgctgctcatgctgccaaccgcaacgatcgttatgttaggatgtatgttttattcgcacacttcttttgaaggaatgaacagggtcatggttccggtaggagcttcgcttctgttaatgacgaatatcttcattttcacagtatttgacaggtttgtagaaaaatcagaagaagtgaagaagatggaccggctataccagaaaagcagggcggagattgccaatctgcagtatatgaataaggttaatgaggataacagagcattcttacacgatataaataaatttatctgtacagtagccggcttgatagaagaaggagagaatcaagaggttaaggacatcatggaacatttaggcgtccggattcagaatcttcaaaaaagtgtatattgtgagcatccgatcttgaacagcatcctatgtgaaagaaaatttcttgcagaatctaaggatatatcctataggattaccctgggtaatgatctcagactggattttctggaagagttggatttgatctcgatcgtagggaatcttttggataacgcactggaagcggcagaaaagacagaagatggcagatatgtggaatgcaggatgtatatgggaaatgcggggcatttccttgtcatggaattttgcaatgggtatgtcgtccctctgttaaaggacaaggacaggtacataagcaccaaaagagacgcggacagtcacgggatcggactgcacacggttggaaaactggttaaaaagtatgcgggaattatgcgagtggaggcaggagaacgggagttctctgttaagctgatctttacaatcaaataaggacgtgcaaaaatcgcccaaaaagttaccgtttttgccgcggtaattgaaaagagggcgatttttgtgtaaactttcggaaaaaaggaggctttgtaactatgaaaaaaataatcagaaaaaacctgggaatcaaactgcttggagctgtaaactgtcttgcactctgcttgacggcgtatacggcaaatctggcgtgcaactggctgtactatcaggaagatgagccggaagaagttaagaaaatgaggaaattctagtgtggaaaaaaatggctggtcggctttttgaactacaaagcaggaatgggattcttgaagagaaagaccgcaggctgtatgaatatgcttacggcgtactgctgggcagggtggtaatataccttatcatcgtcatacttggcatcataacggggaattggatggagatgatagtctttttattgccctttactgttttaaggcagtatgccggagggattcatttggaaaaggcagggggctgcatggctgtttccggtatccttgtccttctatgcagtctgtatctggcgtctgctccggctgtaatatggcaaatgcggatcatatggtttgtcgcggttggcgttatatttatcatggcgccggtagatgccagcagcaagaagttggatgcgaaagagaaaaaagtttatgggatgcgcgcgagggtaattttagttattgaatgcgcgatagcaggtgttttttctgtgattggatattccctgatcgtaaacgggattatggtagcgcatattgttttggcgtctggtttaatattaggatggaccaaaattttttttgataaagagttagagtgaactaatccatgataggaataagaaatacctgggaaaagcgtattgcaaaaggatgataaacagaacaaaaagaacatgatacaagaggaatataaaagtgaatttgaaattgataaaaaatacagaaaatatcaacaaagagaaaataaccttgttctgcctgccgtttgcaggaggcggcgcgtctgcttataatcagtgggcgaaaaagatgcagggaaaagtaacggtatgtccagtccagcttccgggaagggaagaacggatcatggagaaaccgtatatagatatgccggttatgttagatgatctggaagaggctgtaagagaggttgtggacggaccgtatgccttatgggggcacagtatgggcgggaagatctcctatgagctggaaaagcgattggaggcagagggatatagagcgaaatacctgtttatttccggcagccggattcccagcattccggaaccgaagccaatctatcatcttccggatgaagcgtttaagagggaactgggaagatttgaagggacgccaaaagagatactagagaatcaggaattgttggatttctttctgcctatgctgcgggcggattttaccatggatgaaacgtattatgataaagcgggagtagtgctgcatacacctatctctgcatttggcggagaaaaggacggtgaagcggatgagagtgcaatctgtgaatggggaaagtatacggataatgattttgactaccgaatatttccgggagggcatttttatctgcgggattacgaagacgaagtaataagtgaggttgagagacggcttcagggaatgaaaaatggaggttaaacgatgcggggagaaggaatttctgtcagcagacaaacttcgtatccgtgaaaatgagatacatatatggtgcatctgttggccggaaatgacagatttctggaagaatcatgaatatatcctgagtgagcaggagtcggagcaagccggaaagttccgctttcctgaagacaggatgcgttatattgccgggaaacttatcgtgcgaattctcttgaaaagatacttagatgtggaaacagttgatttttctgtcaatgaactgggtaagccttatcataaagaaatcgcaggaaagcagacagtcaattttaatatttcgcattcgggggaattcatactggagggattcgctgtcggaatggatatcggagtggatgtgcaggaaatggcaggatgcccggattacagggagatagccgggaatttctatacggcagaagaagcggaagatgtaataaatgagggaccggaactgtttttccagtattgggcggcgaaagaagcgtatgtaaaagcgatcggtattggattgggaagaggaatggatttcttctctgtcagaaacggggaaattacagaaaaaggcaggaaaggccagggatggcatttgtatccagtaaagattgagggatatgctgcgtatgtggcggcgcataagaaaggagacaaatcaaatgagttataagaaggatatgagcaaatacgagcatctggaaggatgggaacgatgcggctttggagagcagcttgataagtgggcggaaaaatatggagaaagaactgcggtcacggacagcgaagacgagatcagttatatggaattaaagcaaaaagcagattgtcttgcggcagcttttctgcgtaaagggattttaaagggagacaaagtgcttgtgcagcttccgaataggatttcttttgtgatcgtgttttttgcgctttccaagattggggcggtgccaatcatgatgctgccggcccacagggaggcggaactggaaggaattattgaactggcaaagccggccgcttatattgtggtggagaaatatctgggattttcatatgtgccgatggcaaatgcgatgaaagagaaatattcatgtatccggcatatatttgtagatagcgaatccggggatatcagtggaatgattgcggaaacgtgtggagaaaatggagcatttccggctgtggatgggtatgaaacggcggtgcttttgctgtccggcgggacgacaggggttccgaaactaattccgcgcacccatacggattatatgtataatgcccgcatgtccgcgaagagatgccgcttggatagcagtgacgtttatctggcgtctcttccggtagctcataatttcccattatgctgcccggggcttttaggcacgctggacgtgggaggaaaagttgtgcttgcgtctgcgaccagcccggatgatatccttgacgcaattacagaggaaggtgtcacgataacggcattggttcctgctatggttactgtgtgcatggaaatgctggaatgggatgaagattatgatatatccagcctgcggattttgcaggtgggcggcgcaatgctggaagattcccttgcggataagatcattgaagaatggccgtgtaaactgatgcaggtatttggtacggcggaggggctactgtcctttactagcccggaggatgaaggttccctgatcgcaagatgtcagggaactccggtgtctcctgcggatgaagtgaagattgtggatgaagaagataaggccgtaccggaaggagtttttggggaattattatccagaggcccgtatacgattgatggttattatatggcggaggaagcaaataaaaagagctttacgccggacgggttttaccggacgggcgataaagctatgtggacgaaagacagaaggttacgtttgggcgggagaatcaaagagcagattaaccgcgccggagaaaagatcatgccttcagagattgaagcttacctttgcaggcattcgaaaatcaaagaggcagccgttgtcggcgttccggatgaaacccttggaaaccggatatgtgcattccttgtgaccgatgatgaagccgggatcgatttgcaggaaatccacaggttcctgcgggaaataggcgttgcggcgtataaaatgccggatcagatagaacgggtagagacatggccgctgaccagcgtaggaaaaatagataagaaagcattagaacggatggcgcaggaaaaatagaaggagacagaatcatggaatatatagagataaaggaacagatcaaacaaaagctgccggtagccagagatttgggggattccgaaaatctgctggagcttgggctttcatccctgacgatcatgcgtctggtaaaccagtggagaaaacagggggttaaggtttcattcggttcattgatggaaaatcctacccttgaaggctggtgggcgctgatccagcgcagcatgaagaaaaaagcgggcaaaaaacgggcgcaaaaatctaagataacgccggaaaaggatatgaaacagccgtttcctttaacagacgtacagtatgcatattgggttggcagggatgaagaacaggctcttggaggaatagactgtcatgcgtatttagagtttgatggggaaatatagatccggagcgtctggaaaaagcatggaatgtgctgcagtatcatcatcccatgctgcgtgcctgctttttggaagatgggacacagaaaatcctggataagccgtattgtgaaaaaataaaggttcatgatttttcacagatgtcatctgaggaagcagaggcaatggcagtatctgtcagagaacgtttatcccatcggaagctaaagatcgaggaaggcgaagtggcaggaatagagcttacgctttttcctgaaaatagggcacgcatgcacgtggatatggcacttttggttgccgatgtacagagtttgcagatcttattgagggatttggcggctgcctatcgcggagaaagccttccggcagaatcaaaagggtggaattttgcttcttatctggaacggcagaaagaggaagataaggaagagagaaacaatgcagaaggatactggaaaaaacgcttggagcatttgccgaaagggccaggcctgccactggcaaaacggccgcaggaagtgacaaagactgtattcaaccgcaggattgtaaggattggcaaggaagagtgggctcatctgcaagtacgggcaaaggaataccagacaactccggcaatggttcttcttactgcatatgcgacggttttggaacggtggagcaggaatcatcgtttccttattaatattccattttttaaccggaaaacagagcagcagggattggaagacgtgatagcagatttcactacactgttattgctggagattgactgcgaagggaatccgacgtttgcagaattgctagacaggattcagaagcagctccatgaggatatgaagtatacggcatattccggcgtgaaagtccagagagaccttgcacagatgtatggagacgcatcggcagtggcgccggttgtttttgcctgcaatctgggaacgccgttggtaaatgatacgttccggaaagaactggggcagttttcctatatgatttcccaaacgccgcaggtgtggaatgacttccagagttatgaagatgaaaatggcgtacagcttacatgggacagcgtggataagttattcccggagaatatgatcccggatatgctggagtgttttgagaatcttctgcatgaattgggaaagaaggactggaatcagcgatttgatgtgcttcctgaaaaaagaaaaagagaaattgaagatacagcgcgtacaagagtgccggagcgtgtggaatgcctgcattgggctgttatgaaccatgcggaagtttgcccggaagatattgcgcttattgatgcgggaagcggaagatcggtttcctatggggaattaaaagcacgggcgacagcagtggcggcagggatttcagaaaaggatattaagggagtcccggttgcacttaccctgccgcgcgggatagaacagatcgagacggcattaggaattttgctttccggaaattcataccttccggtcagcttaagccagcctaaagatcggagagcgttaattcatgagaagacgggagtccgctatgtggtcacgaatcgggaattatccgaaaaactggactggccggaaggtacggaaatccttgtgatggaaggtatggaagagggacagaaaaatgtgagactgccagaggtgtcgccgaaggacagcgcctatatcatcatgacgtcaggctctacaggtgttccgaagggtgtagagattgcgcatgaaagcgcatggaatacggttcaggatattaatgaaaagtaccatgtgacaagtgcagatcgggcgctggctgtatcagctatggattttgacctgtcggtatatgatgtttttggaattctaggcgcaggaggaacattggtattgcttccagagcaggagagaaggaatgcggattactggctggaacaagtgttgaaatatcagattaccgtttggaattcagtgccggtgcttctggatatgcttttgatacgggcggaatccatgaaacagaaactgccgatcagggcggttatgctttccggagattggattgggatggatctcccgcagagggttgcggcatggacagaggattgccagtttgtcgctatgggaggagctacagaggcaagtatctggtccaattatcagaatgttaccctgccgatgccgaaaaactggaaatctattccttatggaaagccactcagatatcaggcatatcgtgttgtggatgagtatggaagggattgcccttactgggcagaaggcgaactctggattggcggttttggtgtagcaaaaggatataggggagattctgcgcttacggggcagaaatttatcacagatcagtatggaagatggtatcggaccggtgatctcggaagaatctgggatgatgagacaattgaatttttgggaagaaaagaccatcaggtaaagatccgtggacacaggattgaattgggagaaattgaacatgctattcaggagtttccgggtgtggctcatgcagttgttgatacagttagtgatggtcatggcaataaaacgctggctgcttatatcggagcgccgctgcaggaagattctaaagttacaacgtatttgtacggcacagatatctttggcgggggctggaaagaactgaaggatgatgtcagcaattggcagatgcagcaggaacggaagacagcatacaaaaatttccttgcctatgcagaccagagatgtgtacagcttatgctggagacactcatagagttaggcgtttttgtatcagagaaggaagttctttcgcagaaggaaatttttgaaaaagggagcattacggaaacacagaagaatactgtggcaagatggttggaaattttaaagaaggaaggaatcctgagagaagaggacggcagactatcgcgtaccgggaaggaagtagctgtaccggaaaaagctggagatgcggaaacgtattttaagaaactgaagccgtatctgaagcatatggttactgggaatgaagttccgctggatgtattttaccagaaagattcggcgctggctccgaatatgttgcttcggaggattccgggttacgaggagaccgtggaaagactggtgcaggaattaaaacttctgatagaagggcgcaggaaagaaccactccagattatagagattgggacaagggatgctgcaattacaagacagattttaaatgtgctggaagatgtaagtgtggcgtatacatatgtggattcttcaaaatattttctgcaggaagcggagaaagagcttgcgggatatgaaagagtcgagtttgaaatgctgaatctggaagaaagcatggacaagcagcagatggctctgcatagttatgacgtcgtgatatcggtaaatgctttgcatagaaatattgacgctgtggatgcggtaaagaaagtagcggaattactgaagccaaatgggatattgttaatgacagatcttgtggtaaggacatatcttcaggagcttacagcaacttttttggaaaatggtttcgcagatattcgggacaagagaaaagaagcggggatggttaccccagattgtctgctgtggagagaatgcttatcagaggcaggattaggccaggacattgttgtaacagaagaatatgggagatgtatatgctgcagtaggcagcaggcatctgtcttgtcctattatgatggagcacttagggaatatctgtcggaaaagctgccggagtatatggttccccaaaactatcattttatggcacagcttccaacattgtccaatggaaagattaaccggaaaaaattacgggaagattttaaagaagaaacttcggttatcagattttcaaaagcagtaacggagacagaagaaaaacttttggatatttggaaacgaatgtttggttatgaaaatttagggactgaagataattattttgttttaggtggtgattcattaatagcaaccaaattgatttcagatattcagaaagaatttggctgtaaaattatgattagtgatatttttgaaaatgttacgataaaattattggctcaaaagatagatttagtaagacaaaatgtcattatggaagatatcgagatggagtgtggagaaatttaacattgtcaaatctgttttttagtatatttcataatgaaaaatagctcgcatttttaggggcaaattacgagtattagatattgaggagtgtaacttgtccctattttattgagaaggtgagaaaatgagaaaattaaagtcacttgtatgtggtagtaagtttggacaattttatatagatgctattagtaagatgaaagagtgcgtggaattcataggcattttttctaatggaagtgaacgatcaaggctatgtgctgaaaaatataatgttaatttatatacatcgatagataaaatcccagaggatatagacattgtatttattgctgtcagaacgggtgtaatgggaggtgatggaagtgaactggcattaaaatttttgtctaaaggtattcatgtattcattgaacagcctattcatatagacgagatgaaaaaatgtgtaaaatgttcaattgagaagggggtattttttcatgtagcaaatttttataagtacatggacactgttcataaatacattgagtgctctaaagggctgttgaggaaaaatgaaatattgtcaatagaatgtgcttgtgctaatcaagttatatatagtctactggacaatattttgagaattttcagggaaaaggcaagattttcgattgaaaatttttggatacaaaatcaagatttttttattgcttcaggtagtattaacgatataccgttgagtattaaagtatataattctgtaaatacagtcgattctgatagttattgctattatttacaacagataaatatttatacatcggaaggaatgcttttcatggttgatgttaatggaccgattatttggaaaccgcaatttcgagctgctcatgacttatttatcaagaagggggatgaattagatcagaggatatttgacagtaaaatgtactggtatgagtcagaaagtgagttgagctataaagatattttttgcaaaaaatggatagatgctataaaaaaagaaattaaagaatttatagataatatttattttgaaaaaatgacggaatatcgtcggaaaattcaaagtgaaattgtaattcccagtatatgggggcttataactcaaaagattggctacccaagattgtatcaaaatgcaaatcatgcagttgatttaaataactatgttttagatttttttgaagaaaaaaacacctttttaaatgattcactagaaatcaaaaaaactgcaaacaatattgacttttatttggaaccagatattacatatggttatgttgaagaagcaaaacatataatgaatatcgcatgtttggagtctatttcatacaaactgtacgaggcgactggggagaaggagaatatatcaataacagaaattgtaagttgcttaaaggtggcagattcaaatatgcatattttacaaaggtggcttaatgctttaagtgaaaatggatatatagaatgtaatgctgggaaaattaaatggaaaaagaaaaatacaagtatatgtgagaaagacaattggaaaattgtgtctgataagtgggttggaaaattatcaggagaacatgtcattaattattatttaaaacatattgaaaaaatggaagctttgttatcaggagaaatgaatgctgcgttattattgtttccggaaggaacaatagagttagctaattgtttctatagagaaaatttaatggaaaaatatcttgcatattgtatagaaaagattctttcattcgctatagaacatactaaaaaagataaaattaggatattagaattgggagcaggaacaggagcaacaacagacagaatattaaaggttcttgaaaattcaactaaaaaaatagcatatatttattctgatattacaaaatattttctcaattttgctgctcaaaagtaccagggaaaagaagaattagagtataaggtgataaatattgattctaacttaagtgaccagggaattgctgaagagagtgtggacattgtcatagctgctggaatgatgaataatgctgtcaatacggattattctatgagacaaatcatatgcagcttagtacatggcggtattgctcttattgctgagccagtgggagagaattatgagttaatgttatcacaatcatttatgatgagccggccaacagatgcaagggaagtatgtaatgaaacttttttgaaaatggaggaatggaaagaagttttttggggttgcggaataagtgaaagagagttagtggtagtgccaagtgatactagtccattagcaccattaaatcaaaagttatttattataaggaaggaataatacgctatggatgcaaataatttaaaaaaggcttttgaactttttgtaaaattgcaggataagaaagtaaaacttagtaatgttgatggaaaaataaaatatagagcgccgtcaggaattatgacaaatgaagtcatagaggaaataagaaaatgtaaaaatgaacttctgacaattattaattgtaccgagcatccagaaaaactatggaaaggaaagcaaggagacagttttccattaacagatgtacagtctgcgtatttgattggaagaaaaaatatttttcaatatggaaatgcagcgtgccacatttatatggaggttgagtattctgaattggattctcagcgtgtagaggaagtgtggaatattctaattaatcgacatcctatgctgcgagtaatctttagtgatacaggaattcaaaaaattttaagagatactccttggtatacgttgtatacaaatcgcaacataacatatacgcaagaaactttgcaaactgaattaggacataaaatatatgatgcttcaaaatggcctatgtttgatatagggtgtgtatctggtcacaataaggctattctgggtatttctatcgattttatgatagcggattgggcaagcatatggatattaatagacgaatttgaaaagttatatcaaaatccaacggcttcattacctagaattgaatacaattttagtgattatatatactgtgaaaaagtaaagaagtatacaccaaaatatttttctgatcgtgaatattggatagaacgcttagctgagtttcctgaaaaaccggatctccctattattaatgctgttgagaatattgataaaaatgttatatttaaaagatacaaatttgttgttgaaaaaaacaagtggaaaactatacaattgatttctagtaagatgggattgacaagttctgctgttattttatctgcatacgctatggttatttcaaaatggagtaccaacaaaaaatttgttatgaatttaacgactttaaatagaaacagttatgaaagcaaagtaaataatattgttggggattttacttcaataaatttgttggcagttgatttctcaattcagaagagttttagagaatacgtgaaacaaattcagcaacaattattaacagatatggaacataagtttttttctggtgttgaagtattacgtgaattgtctcaaggcaaagagaatattatcatgccatatgtatttactagtggaattggagtgatccggaatactaagaaagaaggttaccatggtaaatattatcaaaatggtatttctcaaactccacaggtgtttattgattgtcaagtgtttgatcaggacgatgagttattaataaattgggatgtgcgagaaggaatttttttgcctgaggttatagatgaaatgtttttaatgtttcaagatttaatttgcaattttttgattgacgcagaaaattggaatgtagaaaaggtgactgctatattaaataaaaacattaaaattagtaagaaaaaatatgatttgccgagtggcttgttgtattcttctattttggaaatggcagaattatgtcccgaaaaagaagcagttcaagatgaaaatgaaatatggtctttcagtaaattagtaagaaaaagctggttcgttcaaaataaacttcaacaggaagggtgcattccaggagatcttgtggggatttttatgccaaaatcaaactatcaaatagcaagtgttcttggcgttttaatgaacggatgcacatatgtaccgatagatattcaacaacctaagaaacgcataaatgaaattattgaacaggcgggaataaaatatgttttgataagtagttgtagcaagatagagttaatgtttttagatgttaagtacatttatgcagacaaacaaaacaatgaaataattacaaaacaaattccgcaagtccccaatagcagcatagcgtatgttatttttacatctgggagtacgggaaaacctaagggggttgctatttctcatttgtctgcattgaatacaatatattatgtaaataaaatgctgaatatttccactaatgatatagtttttggagtatctcgattaagttttgacttatcagtttatgacatatttggaattttgtcggcaggaggaaaattgttcttacctgatgaaaacagaattgcagatccttcttatttatttgagacgatagtgaaacaaaaaattactgtatggaattctgttccagccataatgcagatgattctggaatacagagaaaatgaaaaaagaacggaacagtttaacataaggtgctcattgctgtctggtgattggataccgctcactttgccagaaagattaatctctgcttgtatggaaaaaacacgggtaattagtttaggtggagcaacagaagcagcaatttggtcaatatattatgaatatgaatacctttttgatgaatggaaaagtataccatatggaaaagctcttccaaatcaagaagtttatgtattggatagtaaaaaagaaatatgcccgttgggtgctgttggagatattttcatttctggtataggattggcaaaagggtatttaaatgaaccgctactaaccgagaaagcatttattatggtaaatggagaaagaatgtatgatacaggtgataaaggaaaatatttagaagatggaaatattgaatttttaggtcggcgtgatactcaagtaaaattgaatggatttagggttgagttaggagaaatcgaggctaatatagaaaaaattaaatccgttaaatatgctgcagttttgtgtagagaaaagggacgagaaaaaagagtaattgcatatgttgaaccgcagccatctgaatttacggaagattttagcctatatgtattaaatgagttaaaacgaatgcttccggcatatatgattccatacaatatacgtgtaatgaaattgccattaacatctaatggtaaaattgacagaaaatatcttaaaaatatagaaattgtagaggacaaaaaagaggcagatacgaaaaacacaataaatagtgattcatctacttattttccgataaaagagatatggtgtaaattgctacagagaagcgatattagaccagattcggatttgcgtagttttggagcagattctttgattatggcacaagcagttggaaaaatacgaaattttttaaaagaaagtgggagtcaatgtgatgtaccgtttgatatattgctgaaacagacgattaattccccgactttgagtgagatagtttcatacatagatcaaattattttaaaaaaagaagtgaatagcagatatgaagatgctgaggtaaatgaggaagaacttggcaagctaaaaattcataaaaaagggaaagaagataaattagttgtgattttccacgctggcttgggatcgattgatgaatttttaccatttatacaaggtctatgtaatgaagaaaaggggactattgttagtatagcattaaataatgtaaagcaatatttagatttttatgcagggcatttatatgagagtgttgctgataaatatacaaaaattatacttgacttaggctatgataaaatacaacttattggacattgtgttggcggaatgatagcttttgaggttgcaaaaaatatgatggataagggagttgatgttattgatgtctctctgattgatagtataccagggaaatatagtattgaggatgaggtagtaatggaactaatgtttttacctatggtaaatataacgtatcctgtgttggcggaatatcaattaaatgagcgggaattatatgaatatatggatgagaaatttggaaaatatacaggaatagaacagaaatctaaaaataaagtagaagaatacataaatggtcttcgggagattgagaaagaggaaagaataagactgtatataaacagtgtatcgaaaaatatgccaattcaaatgtttgtctatttatttgatatattcaaacaaagtacaaatggagctatatataaacctataccatatttaggtgatattcgtttatttatagcagaagatacagagaaaattgtattccatcgaagtgaagaagttataaatttttggagagaaaattgcattggtgatgttactgttattatgattcctggaaatcatcttacatgttttactgatgtaaacaatattcagaagttagtaaatatgattacagagaaatagtatccgaaataattaggtgaatcaatacaataaggagaatgattactccgatttcttcggagccacttgtccggacttatatgctaacaccagatacaacctgtacctacgcatggacaaactgatgaaaaaccatctcatgttcctgcatgacagaagggttccgacaagtaataatgaagccgagagacagcttcgcaactataaaagaaagcaaaagcaggtcgtgtccttccggagtaaccaaagccacgattatctctgtaaaagcatgagcatgctggttgtgatgcgacaaaatgaaagtaacctctttgatagagtatccaggattctggattaagaagagccagtggttttgactgattacagtttacaccaccggcttttcttaatcaagttcgcacctgaacagtaacataaacaacacgcatacttcaaaattcaaaaaacatccatggactgcggccatgaaaatatgctatactaactgtggtttacttatgctaatcagggagaaaatacaaatgagcgaacagcaatttacagacttttttgacccggaaattcaaaaaattgtcagcgaagatggctgctccatttacagaatgaaaaatgtaactggggagggtgttatcactcgctatgaaattcttccgggtattgaattattctataatgattttcacatgagcgatggacagaatcaaaacaagcttccgcactctgatgtacttgaaatcaatcattgccgggagggacgttttgaatgcgaatttgctaatggagattatcagtatgtcggtgctggcgatcttgcaattaaccgcctgacaaacgaaactacatcaacttactttccgttgtcgcattatcacggcatttctattaccattgatctgcctacggcagatcaaactatgaagcggatagaaagtgtgattggaggtctgaatatagatgtcttttcgattgcagataagttttgcaagaatgatacctgcattgtattaagaactcaaagcgaaattgaacatattttttcggaactttatcgggtggagcctcggatgatcgcttactatttaaaagtgaaagtgttggaattgctgatgtttctgaatcaggtttcgcttcaggattaccaggaagaacgaagatattttgcaagaaatcaagtacaaacaataaagaaaatgcaggaatatatgacagctgatcttcgcaaccattatactttgcaggagttatcagaaaaatttgaaattcctcttacctcaatgaaggtttgcttcaagggcgtttatgggtgttctatttatgcttatatgaaatcctatcgtatgcaggctgccacgatcttgcttcgggatacttctgacagcataacagaaattgcggctaaaatgggatacgataatccaagtaaattttccgaagtattcaaaaaggaatttggagaactgccttccgagttccgaaaaaagttgtccaaatagaggatgtttggtctttttagagtggcggcaaaataccagatacaatatactatcatctgtactagcagatgatttaagagcgtcgtgcagacgctcttttttttgaatagaggttagattgttctaacccgcgaaggagtcggtattatgaaacgggatatgagaaaatatatcctacggaaactggttgagctgatatttactttattgtttgtaactctactgtctttcttgctgatgagactgtcatccgttgatccagccacagcttatgcaaagaggatgatcggaaaccccacagcggaacagattgaaaagattcggattcagttggggtttgataaaccattgcttgtccagtatggccgttgggtatgggacttactgcattttgatttaggcgtttctttggcaaatggacatgatgtttggacggatattgccacagcctttccgaaaacgcttggaattgtagctctggcatctatctttcaggttgttttcattgtaatcgttagttgtattgcctttttacttccctggaaacttccgaaaaaggcagtcaggcttttgtgcattttgggtgtgtccataccctctttctatttggcaaccgtttatctggattattttgctgttcaaaagtcattaatttctgtggcaggaaatacaaccctactcagctacatatctccggcaatctgcattggcgtattcggggcttctttctatacgccgcttctgatggatgctctggagcatgaaagcaacgaggattacgcattttatgcccgttgccgtgggctttcggaaaaaaggcttttgctgtgccatttttttccgcgggcagcgatgggtttagttccaaactttttacaaagcattggtttggcactggctaacgcaacggtgattgaatccattttttcaattccgggatttggttatctgattgtaaaccatgtgcttgatcgcgatactcccatgatacacgccgaggtgttttttctggcgctggcgattgctctttgcaacattgccgctgacttggtgcagtgggcaatcgggcgtaaaaagggggtggcgtaaatgaaaacgaagcgttttcggaaatggtgtgcgattttcattccaacccttgtgattattttcttttttgccggatttttatttgcacccaacgatccaatgaaatcaaacttgttggagagatatgctgatcccagcgcagaatatccgtttggtacggatgctttagggcactgcattctgtcacggattctttatggtggctggacaacgctggggattgtattaggaggctctcttattgtttttctgcttggcactgttatcggaatggtgacaagccgggccattatgaaagaaaatgcacttattgatggcctgattaacgctgttacagccattcccccgattgcgtatttaattgtgtttattggagcctggggcagcggagcgaaaactactcttgtcgcgctcactgtgtcttacattttgagatacataaaactggttcgtacccgtaccgacatggaaatgggaaaagcttatgtcatgtgtgcaatcgcttccggcgcttcaaagctcagaatcatgctgattcatattttcccgaatttgattgccgaaatgattcgctttctgtgcctttcctgtgcggatatgattctggctattaccggattttcctttattggattagggcttggtgataatgtagtagattggggaagtatgattttagacgcaaggggtgctttggttcttcacccgaccatgattctctatccaataggggcggtaattttatcgacactctgctttaacgtcattggcaggcagttgacaacgaaggaggcagagtgatgttaaaaattgaacagttagatgtcaaggaacggtcaggccgctaccttctgaaagacatatctatggaaattcctgcaggccatgtgattggacttacaggtaaaagcggctctggaaaaacaactttgctgcggagcattttggggatgcttcacacaagctgtcatattgatgccgggaaaattttgttggacgatatagatttatcacatctttcccgcaagtcacatcgtgagctttgtggaaagaagcttggatttatcccccagaaccctatgacggcttttgacagccgattaaaaatcggttatcagatgcgggaaacctttgtcaatcgtttgcatttgaatacaagtgaagcaactgacctggcgaaagagaaactggtttccgtaaatctaaaagacacggatcggattttgggtgcgtatccgtctgaactatcaggcggaatgctacaacgagtagctgcggcaatcttattgggaatgtcgccggattatgttttagccgatgaaccaaccgctgcattggatgaagaaaacagggatttattgcttctcatcatgcaggagcaaatgaaggacaaaggcatattatttgtatcccatgatgtggccgcacttaaaaacttatgtcagaacgtttatgttctgggagccggaaaaattattgagcatggaacgatggataaactcttgtcaagtccgcagacagactggatgaaacaattttccgcgttgagccatagggaaagtcggggtgaatggaaatgggagaaattgtaatccagaatgtaaatcaggtatatcataatgtgaaccagggagattttaatgcgctttcggacatcaacctccacctttgtaaaggtgaaagtcttgctattgagggagaaagcggatcgggaaaaagcacgctggcaagacttctgatcggcattgagaaaccaacttctggcaaaatattactggatggtgaagatataacctgttggaattatcgaacatggaaacagcaccgtaaaaaaatacaggctgtttttcaggattcttccggcactttaaatcctgccaggtctgcatacgcaaatgtagaagaagcactggtgaacttaactgataagaaaagagccgaaagaaaaaaacatattttagatttgatggatgccgtacacatggattatgggcttttggaaacgcctgtccgtcagctttcgggcggcgaacagaggcggctctctttgcttcgggcgattgccgtggaacctgattacttaatcatggatgaagtgaccagcgggcttgacctgatttcggcggatgccgtacttactttagtagagaactttgtgaagctatccggcagctcctgcattttcattacgcatagcagaaaggacgcaatgcgtattgcaaatcggattatcatcatgcgggagggacggatcgccgagcaaggctatctaatagatcaattatcaaaccagaaaggacaaggataacatgaaacagatttacaagaaacttctcgccgctgtattgggcgtgagtatgcttctgtctatggtcggctgtggtcagaatgatacctccgatcagacgcagactggcggtgaaaacgaagcgaaggtactgacgatcgtcacggctaaggaattggacagccttacgacactgaccatgaacaaggaaaacaatattgcctgtggcctggtctatgagactttagtcgcctatgaggacggggaaattgttcccgaactggccgaggaatggggatgggatgagacaaatactgtccttacctttaagctccgtcaggatgttgcttttacagatggagccgcttttaatgcggaaagcgtaaaggaaattctggactttgaccgttccaaccctaattttagcggtatcaagggcatttacaacattgaaagcgtagaggttgttgacgaatacacggtggccgttcattatgctgccccttgcttctcttatatcaatgacttctgcttccagaatgttgctggtatgatgtccccgaatgtgtttgaagctgaaaacttccagacattcacagatgttgtcggcactggtccatacatccgcgaagaaatgatttccggtgactgcacccgttttgtcagaaatgaaaactattggggcgaagctccttactatgatgaagttgtcataaagtatatcccggaggcatcttccagacttcaggcattacagactggtgaggttgacctgatttacggtgctgaccttctcagctatgatgactataatcaggctctttctctggatgggatcgagggcgcaatcaatgatggaaataccctgacccggaacctggttctgaatgcgtccagcgaaattttgagcgatcttaaggttcgccaggcgattgcatacgctgtcaataaggaagaaatcaccaagggcctgacctatggatacgaaactccggccaccagcctgtttgcacccggagcgccctacacagacattacttataacagcacatggagctatgatctggataaagcaaatgcacttctggatgaagctggatgggtgatgaatgaaagcactggtatccgtgaaaaagatggacagcagctttccctgaattacacctattggactgatctttctcttgcacaggacatggctcttgcaattaagacccagcttgcagaggttggtattgacgtaaccactaccggccaggatcagatgacctggtggaccgaaggcgttgcaggaaattatgacattacaacatggaatacagaagggtcttatactgaaccgcacaagttcctgcaggaatccctcggtgctgatcctcatgctatttccttgcaggcacttgaggatttccagagctattcggatgcggtaaatgcgttctccacctctgctgatcccgaagtggttcagagtgcgattgctactgcactgaatgtttccaacgacaatgtgattgaccttccgatctcctattctaaggatctggttgtatataattcctccaaaatcgccggatatactttctccagcgtgccacagttctttgagatcgataacgtacagcctgcggaataaatataatccaatgtctaaatggagtgtttaacgccctatcagagtggcagaaaatagccgaatagatataatagaggttggttagaagtgtttaaccaatctctatttttatgaaaaggagcgtatgtgaaatggacaagaaagataatcccatgtccagactgatggaacttgccgctccatataagggtgaatatgttctttcagtgattttggcaatcctgggtgttgccgccggattgctaccgttttttgcagtttcaaaaattgtgattctcttgatggatggagagacatctgtgtccgtctatatggagtggtgtctgattgcgggaattggtttccttgggaaagtatgctttgcaaatttctctactttagtttcccatacggccactttcgcaactctggcggagatccgcctgaaactagcagataaacttaccagggttccgatgggctatatgattaacaccccatcgggagaattaaaaaatgtcttggtagatcgtgtggagggaatggaaacgacccttgcgcatttagtaccggagctgacagcgaatctctgtattccgatttgtattctgatttacctactgtttttggattggagaatggcgctggctgcattgattaccctgccgattggtatgttgtgctataagggaatggcaaatggatatgaagaaaaattccagggtcttattatgcgcatgcgtaaaatgaccagcactgtggttgagtatatcggcggaatagaagtcattaaggcgtttaatcagtctgctaattcttaccagaaatattcagatgccgttgaagataatgcggcctatgctgtgaactggatgaaaagcgtgcagctttacaaatccatgcttgttacaatctggcccagtgtgttagtgtgtgttcttcctattggctgtgtcctgtaccggaacgggagcctgagcgttccggcatttgttacctgtatcgtgctgtcattgggtattatcacaccaattttaaatgccatgaactttacggacagcatttctcaaatgaaatcagtagtcggggaattgtgcgccgtattggatgaaaaagaactggatcgcccggaaacgccggtgtctattcattcttccaatattgtgttagaaaacgtcagcttttcgtatgaaagcgaaaagccattgctaaaaaatatcaacctttctattccagaaaacagcattaccgcttttgtcggtcccagtggcggcggcaagtctaccattacgaagctgattgcgggattttgggatgtaacaaacggaactgtcaagttagacggaacagatattcgcaaaattccgttgtcacagcttatggataacatcgcttatatttcacaggacaactatctttttgacgaaactgttttagaaaatatccgtatgggaaaaccatccgcaacggatgaagaagtatatcaggctgccagagattgtggctgctatgatttcattctgaatctggaaaatggattccatacagttgtcggaggtgcaggaggtcacttgtcgggcggtgagcgccagagaattgcgattgcccgcgctgtactgaaaaatgcgccgattgttattcttgacgaggcaaccgcttacattgacgccgggaatgaagccttaattcaagaggcaatggcaaaagtgattgccgggaaaaccgttctgatgattgcgcaccgtctttctacgattaccgatgcagataaaattgttgtcataaaagatgggcagattattgacgaaggaacacatgaaaacttattgacttcctgtacgctctatcaggaaatgtggaaagcgcacatggacacaaaagatgtggcgtaggaggtgcgaagatgataaagacattaagcaagatttatcagttttcagggaaaatgcaggggacaatgaaaaaagctatccttttttctgtcctgcactccctttttgatatgatgtcctttggagcattagccatggttttttcgggtttaacagacggttttactacgtctatgatctggatgatatttggaatcaccctggcaagcatgctgcttaaaatttattgcagctacatttcagatttcggcaaggtgcaaattggatattttatgtgcgcggagaaacggattcatattggagatcgcatgaaatatatgccgatggggtatttcaacgatcacaatttggggaatttgacttctgtcgtcactacgactatgggcgatattgaaaataatgcgtccatggtgctaaccaacatattaggcggctatatccatgcagcgattattactattgttatgctctgtatcgactggcggatcggactgacgattttgtgcgggattctgctttttacatggtgcatcggccggttacagaaaaaatcggaaacggtttcgccacaaagacagcaggcccaggagactctcgtttctaatgtactggaatacgttcaagggatgctgattgtaaaatcctttaatctcggtcaaaattccaatagcaaaatgagacaggcaattctggacagcaaggataaaaatctgaaattagagcgtacattcgtcccttacaatatgctgcaacaaatcattctctacggaacaagtattcttgttatagtggaggggttgtacttttacctgaatggaacgatggcgctttccatttgcctgcttatgacagtagcatcatttatgctctttagtcagcttcagtcggcggggaatacttcctctctcctgcggttactggatgtttcgattgacaaggtaaacgaaattgataacacgcccgttatggacgaacatggtaaacctatcaatcccccaaattataatattgtttttgatgatgtttctttttcctatggagaacacaagattctggatcatgtgagcctctctattcccgaaaaaaccgtaacggctattgttggtccgtccggtgccggaaaaagtacgctttgtaacctaatcgctcgattctgggatgttgacgatggaaaaattacaatcggcggtatagatgttcgagattacacactggacagtctgctcaccaatatcagtgaggtattccagaaggtatatctttttgctgataccatagaaaataatatcaaattcggcaatccagcggcttcccataacgaagttgtaaaagcagctcaaaaggcgtgctgccatgattttattatgagtctgcctgatggctacgacaccgttattggtgagggaggcgctacattgtccggcggtgaaaaacaacggatttcgattgccagagcaatcttgaaagacgctcctatcatcattttagacgaagctacatcaagtgttgatccagagaatgaaaatcttctgatgggcgctatttcagagctgacgaagaataaaacggttattatgatagctcatcggctaaaaacagtcagaaatgcggatcagatttttgtattgtcaggtggtcacattgttcagacaggcaaacatgaggatttgataaggcagcctggtatttatgcagatttcattggtattcgtaagaaagcgattggatggaaattgagataagagctcctacttccagagtagtacggacagttcgcttctctatatagaccattgcagggagggacagatcgaaaatgttatacatttggttatgtgccacattatacattaagaaaaaatgagattggaactttgggaagagtcagaagaagatgaatgagggcacaaagtgccctcattcatctctcgagataggtactgattctcgttttgtctgaagtgaatcggattttacatttggagtatacatcaaagcaatgaaattctgctggatgatatctagtgtcttctgttttttctgtaattcctgtttttcgcggacagtagctgcctgttcagattcaagattttcaatccgtttctggattttattagagcttgggattttggtaacaccgagatcctgaagctctttttttagtgaatcgtggagctggtattctgcctgatgcttggttcggtatgcttttggatttttagcagatctgcaatcttcaatcactttacggcaaagccggtaagaatcacagtgtttccgaatgattttctgtgtgctcagctcactgttgatttgcgttattctctgctcagccgctttaacagaagcattaacatcagaaagatgctgctggaaatcttcataattcagtaggttattttcggaaagatagttgaaggtgcgggccgcctctttcaaattattgagctttgcccatcgttcaaatccttctcgattgccggttgtaacatacgtggagatattgatatacaggcgggcttctctggacagatgctttggagcttttactttgctacgattttttgccaggcggatgcgaacattttcttcggaataatagcttccgagagatttcatataagtgaagtttttctgctctggtgcacggaaggacaggtgctttccttggcggatttcatatccggctaactgcatcttttgcagaaattcctcatagttgatggaagcccagattgccttatcaaccgcaacacgtagcttggctttccaactggtgccacgatgatattccatgttctctttatagcttttgcctttttctccgattggcatactggtggtaagtccgttttcatggcagatacgattactgatccggcagagtttatggtagctccgcttattggaaacatacttgtgatgatcaacaaagcttgcagcgttgaagatgatgtgattgtgaatatgatttttgtcaacgtgggtgctgatcacatactcatattttccttttagtacttcatctgcgaattgctgtcctaagcgatgggcggtttcggcatcaacttctccaggtttgaacgactggatcagatgaaatgccaggttatcacctttatccattccattcttttttgccatttctctagtcatagaaaattcaagatctgcagtttccggggaacagccaaaactggaaactaacagtttttcttctgttttatctggatttgtgatgtagtccagagctttcttgtctgttactttaatggggaagatcttaagatacgccataattctttcaccatctctttcaattcttgcatttcttccggatatagatctccggtggtatttaccttttttgcaatctggttgatatttacaccaatcttgtgcatttcctcatactgtttcttcagtggagtggtatctgtgttgacgatgtaaccgtcgattgccattttgcgaagataagctcccatgtttttggtctttgattcaatcatctttctacggataagcttccgttcttcttctgtgacatagaaatggatttctttgcttctctttctttcagccattggcgtgttctcctttctgagaaggtagtagtatcgttgctttcagcttttttcaatttagggcagggttccctaaattgggatttcccggaagtgtatcctcacttcctgtccttgctgttttacctctctattagttaaagtcaggagaaccgggaaaatgcaaaagaatttggcaggtagtacgggatacgaaaatgtggtatgattatgggcaggatatcagaagaatcaggagttgaatagattgtgaagaaagaagaaatttttgaatatgtgcagaaacagtatggcacgattccggaatatttatggagtaaactaccggacagtgcagtacttcgacataagaatgggaaatggtatgcagtgatcatgacggttgaaaaatcgaaactgggattagaaggaagagagctgcttgatatcattgacgtaaagtgtgatccggacatgacaaatatgattattcagacttatggatttttacctgggtatcatatgaataagcagcactggatcactattttactggatggttcggtcagcgaagcaaaggtactggactttttagatatgagttatgacctgattgatggagcaggcagaaaggaaaacaaatgagaaaagcaatcgtatatgcatctgtgcatcatggaattacactgatttttgagcaaaaggaaaaccggggattttattcctcggtttttcggctgttatgcttcagtcttcaacttgaaaaatatcttctacaggcactttcaggtaatgtgccagccggattgcaatctcaagagagggattacgttctccacgttcgatgcggcctatagtctggctgcaggaacctatggcttcagccaaatctgcttgaatgagattccgttcttcacgaatatcttttagtgtattattgattgccattcaatcacttcctttgcttattgttatcagcaggatcatgaacctgctgttgaaatctaatggaatcccggaatttctgcacctttgcattttccgattacttttccaaaaatcttaaaagagtcagattccaaaacttggataggacgatatttttgatttaaagaaatcagataaacaccatctggctcatcgtgtaattccttgatgtaagtattaccgttgagatagaagattccaatttcaccattagcaagagaatctattttctgaatccatgcgacatcgcctgtatgataaagtggttccatactgtcaccggagatccgtacaccaaagtcagtctgctcaggagcaaggtgtcctacgtcataagtttcttttacagaatcttccaggtaatttccagtaccagcagaaactggttcccaggtaatttctacaggatgatggaatgggataatctttgcagacagtggagaaaactttttagaagctttcaaaatatcagcaaattcaatcaatttatttctgccttcttcattcaatccactcataatgttatatggattttctccaaagaaagattcatatatatcttcgatatcaagtaactggcaaagtgtcaggaaaacatgtaaagctggttctcgtgcattggtctcccatttggagattgcttttgtagtgacctgaataccttcctgagaaagcaggtctaccagatctgattgagagtatcctttcttttttctattttctgctaatatttccccgaaatcacgcatttgttcgcctcatttctatttgaattttctatatgcattataccgtatgttagaaataaaatcaacaataatctccaaaatggagaaaatacaaccaagatgttacttgactatctccggaatgtcgatatatactaaacatacagaaattgataagacatcatgttgaaggaaacagctgggaggtgaaaagtttgagtgagcgtgtgatcctgcatagtgatatgaactgtttttatgccagtgtagaaatgctacatcatccggaatttgctggaatgcctctggcagtaggtggcgatccggaagcccggcatggaattgtgttgacagcaaattatattgccaagaaacaaggagtaaaaaccggaatggcattatggcaggcgaaacaggtttgcccggaaattatttttgtaccaccaaggatggatttatatttgcgattttcacaaatggcaagagaaatctattcagagtatacagacaaaattgagccatatggaattgatgaagcctggctggatgtatcagatagtggaaatctgaaaggaagcggaatgacgattgcaagagaaatcagccatcggattaaatacgaactgggtgtaacggtaagtattggaatttcctggaataagatttatgcgaaacttggctcggattataaaaagccggatgcaatcacagagtttaatcgagaaaattataaagacaggatatggcagcttccagcgtcagatttgctttatgtcggaagacagacaaataagaaattgcaaaaacttggaatccggacaatcgggcaacttgcggaatcagacgaaaagttgttagagagtcattttggaaaaataggaaatgtattatgggctttcgcaaatggctgggatgaagatccggtttgcaaggaaggatatgaagcaccagtaaagtcgataggtaatagcactacaacaccgagagatctggaaaatgatctggatgtctggatcattcaaatagcattggcagaaagtgtagctgcacgattgcggaaacatggatttaaatgcaaaacagtagaaattacagttcgagataatggattgtatagtttttccagacagatacatttacgacagccaacgaatattacaaacgagattgtaactgcagcatttcagctatttaaagataattacaaatgggaatatcccattagaagcctgggaatccgagctgcggatcttgtgttagatgatattcccgtgcagttggatttatttggaaatcaggagaaaaaggaaaagttagagaagctggatcgtactgtagatgagatcagacgacggtttggttatttcagtatacagcgagcggcaatgtatcaggataaagtcttatcccacttagacgctggtacgcacacgatccatccacacagttattttcatgggtaattggagggatagatttgaaaaaagcattaaccagaaaacagaaagaaagttatcagtgtattttggattatacgaaggagcatggatatccgccgacagtacgggaatttggaaaattgatcggggtgaaatcaacatcatcagcattttccagaatcaagcagttggagttaaatggatatatccgcagaatcccggcatcgccaagagcaattgagattttatagtgaggtgtcggcatgaacaaagtatatgtagatgtagtagcagagtttcgtaaagacggacagctggttcccatattttttacatgggaggatggaagaaaatatagtattgacagaattttgaaaatcgagcgatgcgccagcagaaaggcaggcggtgtaggaatgatgtacacctgtatgatacaggggcaggaaagccacttgttttacgaagtggataaatggtttatggagagaaaaacagcataaggagagattggtatagacgatattatttggattattaaccggcagggatagtcactttccctttatattcctgcaggttttacataagaagatggatttcggtcagcaaaggcagctcccacaatgccttttggatatccgattctgcaagttgtagtaagtaattgcttcccatcaaaatcatggggaaagcgaactggtctgaaagaccgccagttagtgtgatgatgataaggagattttgaaactgatgacagacagagattatgcaattaaatcaatgaaagaaattaccttccagatggcaagtcatgcacaggattatctggaagttacaatcgaaagacattatactgatattaaagaattgatgacaagctatcagaaattgattttggaaaatcagattgtgttagaagaactggatatggaatgccaggagaaaatcaatgaagatatggcatatgtattgagttatctgagcatttataacaaccagctgaatgtgccaaagatgcaccgggagatgaataatctgatgattatttatggattgtcggacatgatctatcggggaatgactttggtgaagttctatgcaccgaatggtgtgatgctcagtgaaatccttcattcctgtttttgcagtcattataataagacagatgtggaagtacaacaggagttgggaataggcaggacttctttttataaaatgaagaagcaggcacttgggtatttaggattttatttttatgagatcgtggtaccgcaggcaaaggataaaagatttaaaccgtcactgggcgttgaggaagagtaggtgaataatatgagatacgaagattcgatgaaaggtgtagctgctcagataatcaaagaacagcagcgagtcagtaaaattaaaaacaatccagaagagttccattggcatgacgaatatgcaacgttgaatttctttcggtttatctgcaaaaatatcggtaacttgggaaatggagaaattgagaaaatggtcacacgcttgaaaagcatagatcagaaagcagtggaaaaccatgtgaatggtgctgtctgggcatttgattatgataagatgttctgtgtattgatggaaaatgaaatttgccgaaaggtgtgtgaaaagaataaatataatagttggatgaaactgattggaaattattgttttcaagtggtgtaggataaaatagtggcttgtgaaaagctgattttgatgttaagatgaaattgggataggagacatttaggaacctatcctgacatagcaaagaatggaggcgagaatggacgtggcgaaagaagaaatcgtgaaaacagaagaattggaaacacgttacgaaagatacaagggtatcttaaaagaccttaccatcatgagcgatgtgtttatgcggaatgtattcaagaaacgggaatgtacagaatatgttctgcaggtaattatgaataaaaaggatctgaaagtgattgatcaagttctgcagaaagactataagaatttgcaggggcgttcagctattctggactgtgttgccagagattctgaaggcaagcagatggatgtagaaatccaacaggacaacgaaggggcatctcccaaaagagcaaggtatcatagtggtctgatggatatgaacacattaaatccaggacaggattttgatgaccttccggaaagctacgtgatttttatcaccagagacgatgcacttggatacggacttccgatttatcatatagacaggaaaatcgaagaagtcagtgagaattttaaggatgaagctcatattatctatgtaaattctaagaaacaagaggatacagaattaggcagactgatgcatgatcttcactgtaagaatgcagaagatatgcacagtaagatacttgctgacagagtatacgaattgaaggaaacacagaaaggggtggaattcatgtgccgtgagatggaacagatttatagtgaaggtattgaaagtggtgagctgaaaaaagcaaaagcctcagcattatccatggctgcggatggaatgaaagttgataaaatagcccactatcttaatgtgagtgttcaaatggtgcagaaatggattgatgagagcatgagtgttgcacattaacaaatgataaattttaatggagctaccagaggatactaattcttctggtggcttttttgtgtgttgcatgtataaaaaatgaaaattagttccatagaactacaacttgatttgcggattctgtatctttcaattatccatcagtatactaattttagaccgaattatcgttctgaaggaggtgctatgatggatttaaaagcggttggtcagcgaattaaagcagcaagagaagcaaaaaatcttacacaggaagaactggcggcgctggtaaatttaagtacaacacatgtcagtgtgatagaaagaggactgaaagtaacaaagttggatacctttgtagcaattgccaatgcacttgatgtatcggctgatgcgctactgatagatgttgtgacacattctgtcacaggtgttactaatgaattatctgatatgatagaaaaattgccaaaggacgagcagaaaagaattttaaatgcggtcagagctttggtagactaatgaaataggcattgaaatcgaagggcattaagctcttcttttttttattcttttttatggattcgtttgtgaaaaaatcttttttcatagtgataatcatgatatagtagttctaaagaactataaataattctttgaaactggagggcgggtaaatgagagaaaaaaatatttatgagaagattgcagaaaagtacaatacgacaccagaagaagtacgcagagaaatgcagatagccatagatacaggatttgataatcctgatccggccgtgcaggaagaatggaagaaaatgacacttaaaggagaaagacctacaccggaagaagtaatcaattacgcagtaaaaaaaactaaaaggaaaataaaaatatgaagaaaaagataattgcagtgatctcaggagcagtgatcttgataattgctgcaggaagtatttatgggaaatctgaatctggtcataaggaaggcgaaccggatgtagttggaacattttccgtaaatcgagatgaaaatattacagtggttgctaaccggggacatatcggggataaagaagcttttgcaagagaacttttgcagatgtacaaggatgattcattttattcgacaaaattctccacagacaggggatatgcgacgagtcttgatatgaacatctatttatggaaagaggatattgaagatggggaatcggtaatgacagccgaatatagacctgtagaatacggaaaggactatgatgtagtcaatcatcctgataaatttcaactatatatagatggaaaagaagtagaagaataacacggtgaactttttatactgaaatatgtacgattccaataatgatatgaacttatgggaatatattgcggatactttgtgaactttatcctgatacaatgattatgctgatgaaagaaggcatagataactgaatacaagaaagagacgaaagcctcagtagttaagaaaaaactactggggctttttttcgtgcctgaatttctcagccaataactgcgggcgtatcccggcaggataaaggcggagcaggcatgatcctaaacagaggtccgccttctggacttgaaacgagcaacaagatttcaaattcaggaggaacggatatgtatattgaacacccatatttttacgaaggaaagtattacgcaaatattgatggagaaatgatcgagattacaaaagaagttgcgtatgcgatgaataatttttacagaagcagcaaggcaaaaaaagttgagattaagaatgaactgggtgaggttgtggataagatgctgagagaagtaccttacagcggtcagtccattgatggagaaggcttcatgattgaggattttccagatctgaactgtgatgtggagcactgtgtactgacaaaaatggaacagcaggatattcacacagtgatcaatcaactgaactcagaggaacgcatgattatttatggcattttctttgaaaacaagacacagacacagatggcggagattatggggatttccagacagatgctgtcatacaagctgaaatccactcttaataagatgcgtgaaatgtatatgaataaatttttttaaaaaatttttcaaaatcttttgcatctgccaaagtcatttgactttagtaattagaggaagttaaaggacttcctaaaatgaaccatgataactgaatatccaataataactgacgtgacatttcatgcaaagagcacgaggaagatgccgctataggattataagacaaaacaaagatttttagttcagtccgtaatgctgcgaaaaagcactgaccgaagccagctggcaggctggtgatgcgatgatatgtatgagatgcgatacacttgcagatcctgagaagtctgtaactggtaaacctatgaactgctggagcctggaaacgagagtttccgggttgtggtccggagtatgcatccgggcaggttattattcccttcctgcatatgcgggagtaacgattcggggtatcgaggataaatagaatcgagcgagcactgtttaataatcaaattggctatagaggttatgcggcagagctttccgtcttggaaaggaactctgccgtattcctgtggagccaatatagcgctatgaatgctttacaaataaaaaaagattggagagatgacaagtgacgattcgaagaggagatatcttatgggcggatctcggtatgttcccgacaacttcggttcagggtggagtaagaccggtgatcgtagtaagtaacaacaaagctaatacatacagttcagtcattacagtagttccgctgacgtcaagaatatataagaagcggtatttgccaacacatgtatttatcagcaaatatgatatgacgggaatccgaaaaggaagcctggcactggctgaacaggttatgagcatttctacgaaatgtattattgagaaatgcggaagagtaaataagtggagcctggatcgggtactgaaagcagtacggattcagatgggaatggaaggagaagggcatgacggcagaggaatatagaaactatctggaaacggattttgatgatgtagatctgaaggaattgaaggacatccgaaaaataaggattgaccggaatcagacgaaagaaaaaagaatagctcaatatcttagacaagtgggaaatccctatcttgtctgtataggaaatgtaaaagtgaaaatacggtttgcaaacaatggagtatcttttgaagatgcatttgaggaacttttgctttctgtataaaaagtggtggtaaaatctgaagagttatgttaatatggaggcgaggaattcaggactcctcatttctattaggacaaaatcgactcaccctctgggttttaccaatgttgatggaaaggtaaaactaaggaggatgaagatgaatcaaattaacaattcaaagaaaatctatcatgcagccatttatgttcgtttatcgaaagaagatggcgatgttgctactgctggaaagcgtgaaagcaacagtatctcaaatcagaaagatctgataaaaaatttcctaaaagataaaaaggatatagttgttgtatcagaacgggtggatgacggttacagcggttctaattttgaacgtcctgcatttcagatgatgctggaagatatcaaaaaaggaattgtggattgtgtcgttgtaaaagacctttcccgttttggacgtgagtatattgatgccggaaaatatatcgaaagattatttccggcacttggcgtgcggtttattgcggtcaatgatcattatgacagcctggaagggaaaagtcaggcagacgaaatcgtgattcccttcaagaatctcattaacgatgcatattgccgtgacatttctatcaaaataagaagccacctggaagtaaagagaaaaaatggggaatatatcggagcgtttacaccgtatggctaccagaaagattcagataataaaaacaaactggtgatagatgcatatgcggcaggtatcgtcaaagaaatttaccgcatgaaattatcaggtatgagccagacagcaattgccaatgcattgaacaaacagggtgttctttcaccaatggaatacaagcacagtcttggaataaggattcaggataattttaaaacacacgaacaggcagaatggagcgccatgtcggtaaaaagaatccttgaaaatgaagtatacactggaactctggtgcagggaaaaagaacaacaccaaaccataaagtaaaaaaattgatgaaaaagccggagacagattgggttagaattgaaaaaaaccatgaggctatcgtatcagaacgagaatttgcactggtgcagagattattagggatagatacaaggacttctccgaacgaggaaaaggtatatccattatctggacttgtggtttgtggagactgtggggcaatgatgatcaaacgggatgttccggcaggaggaaaggtatacgcttactatatctgttccagacatgcggctacgaaagcgtgtgcagcacacagaataccaatgggtaaactagaagaaacagtattggaactggtaaaaatccatattgaaaatatccttgatatgaaaaaaatcatggattttatccatgaagtaccatttcaagaattggatataaaagaactggaaattagaaaagaagcaaaagaaaaagaagccgtgcgatgccgggagttaagagattatctatatgaggatttccgtgaaggaatcatttcaaaagaagattataaagagcttcatgacgggtacacagaaaaacggaaaaaagccgaggaagcagtccgaagcattgatcagcagatcagtgaagtcctggaatcaaaaagtgataaatatcattggctggattattttgccgagcatcagaatatacaggaacttacaagaactgttgctgttgaactgattgaccagatattagtatatgacaaaaaacatattgaagtcagatttaattttgatgattgttatcaatctttgttacggcagatacagtcggtgggatgcgatgtcagcacaggtatggacggaagaatagaaattcaaaagagggaggtcgtataaatggctcgaaaatcaagaaaagtagattatgtgaatgttggaaataaagaaaatttggttacagaagctgaaaaccagtgtgaaaaagtttcacatgcagccctttatgcaaggctttcctatgagagtgaaaagaacagagaaagaaatacgatagaaacgcagatggttctgcttcataatttcgtaaaagaacagaaagatatcgtggttgcaaaggaatattatgatatatctaaaaccggaactaattttgagagagatggttttaatgagatgatgcaggacatcaaagagggaaatattgactgtgttattgttaaagatctttctagacttggaagaaattatgtagaggcaggaagctatattgaaagagtgttcccattctttaatgtgcgttttatttcggtgaatgatcattatgattcgttcagagatgacataagcctgctgatcagcatgtcaaacgtgtataatgagttttattccagagatttggcaaagaaaataagaagttcataccggacgagctgggcaaatggcgaatttccttccggtcagatggcttatggttatgaaaaagacaaggataatcctcatcagctgattccagatccggtagcggcaccagtggtgaaaaagatatttcagtattttattgatggaatgacttatgcagagattgcccggaaattaaatgcggatgggtatctctgcccgaaagcctacaagctggataaagcaggaaaagcaaatgaaaagtcagcgacatggacatggagtggaggaacagtccacaaaatccttgagaatcaatattatgccggtgatagtgtgcataatcagtttaccaatgattcctgggcagcacagagacagaaaatgaatcagaaagaagaatggatcattatcaaaaatacccatgaggcacttgtgagcagaaaggattttgatgaggtacaggaaaagattggtcatatcgtaaaacgggttaatgaagctcgtaaatcaaatggcaataatgtaagagacttcaactttttcaagcagaaaattgtatgtgcagactgtggaaaaaccatgtatttatatgggaaaacaaaaggcaatcatcgtaggttttactgtggaaataataagctccacgggaagtgtacgccacattctatcactgatttggaagtgaatgattatgtactgcgtgtgatacgtgcacatatcaatgtatatgttgaaaatgtagatttgattcggcggttgaatcaaagacaggaaagcattaaaaaatatgatgtgtttaacagagaaatcaagaaatgccggaaagaactggaaaaagtggcagtacaccgggaaagattgtttgaggattatgtgtgccgtattattgatgcagagcagtatgaaacattttcaaagcaggatgcggaaacagaaaaagagatccagaataacatggaaattttattaaagcatcaggttggatatgaaaaaaattttcacacagaggaagaatgggaaacattgatcaataaataccgcaatacgagaacgctgacaaaggaaatggtcaatgcttttgtagaaaaaatcgaaatacatgaaagcggttctattacggtacgtttggtgtatgatgatatgttggaagaattaagaaaatatgcaaaagaacgggaggctgagttatgccagtaacagaatgtatcgctgtttatatcagactttcgtcggaggataatgatgtagatggcagtataaaagccgaaagtaacagtgtcagtgcacagagaatgctgataaacgaatttatcaaaaaacaggacgaatttactaactgtccagtagttgaatatgtagacgatgggtacagtggtacaaactttaaccgtcctggctttcagaggatggtggaagatgcaaaagcaggacgtataaaaagtattgttataaaggacttttcaagatttggaagagattatctggaagtggggaattatctggaaaaaatcctgccagtccttggtattcgaattatctcaattaacgatggctttgacagtatcaattcctctggttttactggaggaatgagtgtagcgttaaaaaatatgctgaatgcaatgtacagcagagatttgtccagaaaagttcgttctgctatgaaaacacatgctaaaaacggtgaatatatgccggcttttcccaaatatggatatattaaagatccagaagataagcatcatctggttatagacccagaagcggctgaaatagtgaaactgatattcacaatggcggcagatgggaaaacaaaaggacagatagcaaaacatctgaacgaaacccatgtgcttacatgccgggagtatatgtgcagaaaaggtataaaaatgcacagagaaaacgaaaaagaaaagaaactctggtcagtcacaacaatctcagatatgctcaaaaatgaagtgtatcttggaaaaattatttggaataaaaagagagtggcaagaacaggaagcaataaattggtttccaatgataaagaagagtggattgttgtagaaaatgcacatgaaccaattatatccgatgaattattccagaaagcaaatgaaaaagcatttactaaccagaaaagagttcttacaaaaagaggagtagcctgccctattttcttttgtccgacctgtggaagaagacttggttttaccagcagagagactgggtatcgctgtatgcaggcacatatcagcggtcttagtgggtgtgcggaaagtaaaatggacaggaaagaagcagaagaaacagtactggatgcagccagaaatatggcacaactcatttcggaaaatcttgagaaaaagaaaagtgaatggcataaaacaattttgaaagaagaaaatatcgcaacactggaaagtgaaaaaaagcgactctcgtcaagaaaaatgaaactgtattctgattatcgttcagaagtgttggacaaggaagggtatatggaagaactggaaaaaacgacttcccgtatttcagaaatcactttgcagatagcagaattggagaatgagattgcagtagcgaagaaaaaatgtgatgaagcaacagaaaaagaaatggaagtaaatgagattgcagcattgcaggattttgacaaaatacagctgtcaaagattattgagaaagtctttatttatgaaccaggtcgtatggagataagctggaagatggatgacattttctacaaagaagaaaaagcataaacggaataagattgttcgcaggagcatcactggatgaaaacagtggtgctttttgcgaattaaaagcaaattttttttagacttatattgacaaaagcagagctattggctctcacaaaagcagattttgatttggaatctaagaagcttagaatcaataaaacttatcaagttattaaaggaaaatcaatgattacttcacccaaaacggaaaaaagtaatcggacaatagaacttccagaatttctgtgcgaggaaatacaggattacatcgaatcactatataaagtaaatgaaaatagcagactttttgaagttacaaaaagttatcttcaccatgaaatggacagaggcagtaaggcagcaggaattaaaagaattagaattcatgatttaagacattccagttgtgcattacttattaatcttggatattcaccaattcagattgcagaacgtctggggcatgaaagtataacgattactgaaagatatgcacatttatatccttcagttcagaaagagatggcaaataagttagataaagtatttaaagaggaggagaaaaatgattgaaggtcgtttaagctataattgcaataatgatagatatggacttttagtatctgacttatgggaatatgagggattccattgcggagatcctttagaagtaaaagttgatgacaaatggattcacacacggatagaaatggcctgggatgaaaaaggaggacattggtatttagtcggaacaccgtactttgacaatctggaatatgtgtgtgtcagattcaaggaggataaggatgtatgaggtagataaaatttatcgaaggcctacacagtctaaaggaaaaagaaaaagcagaagcaagaaaaatgaaaaaaacagagtgcgaaatgtaattatgaattttcgtgtttctccaacggaaaaggaactgatagagactcgaattaaattgacaggaatgttaaagtcaaagttctttatacagagttgcctgtatcagacgattcttgtcaaaggaaacattaaaacttttacagagataaaaaagcagatagaacaaatttcaaaacagattaataaaaatcctaatttggaggaattagaaccagagcaggtggagtcacttagaataattcttgaaattttaaatactttgtttcgaaaggagtagatgttaagggcgagtgggaaagcagattggaaaaagatagataagattccaattacatagacatagaggcttatgcaggtgcactgtttcggtgaagggggttttaggggttctcccttaacaagatgcattttgtgtgtacaaaatgcgtatcttgcaataagcttgacagcttattagtcccttttttgggatatagttccctgatgtgggacacgtttatttcccggaaaagggatataattctacagagaaaatgtacatagctcccgtatttggtacaaagttttacaaaatacaacaaggaaggaaatgttaaaaatgggaaaagacaaacattatagaatgacagaagaatcattaacattcatcgaaaagagagataaagaaaaatatcccaaagaaaatttatttgtaaatgcagcaatacaatattttggaaggaaaatcgaacaggaaaagattgttggaaaattagaggatatacaagataagttagaacgaattgaaaggatgctagaagaaaaggcagtaagaaaaaatatggtatcagataaggtagaaagaaaagaattatttggaaaaccggattatttaaagtagggtagataaagatgaattggaaaaatcagattgaaaagttaggagagaactttaaaaattgacggaaagaaaaaggttggaaaagaaaaaaagtagtgtatttgaatcagtaaataaaaaagatgagcaatattaatcgaatattgaaagaaaagaaaatattgtatctgtagaaaggaaggttgaaatttcagggaaaagaggtaaaagtagagcgaagaatgttcaagactttaagaaaaattatgaaaataatttgagaaaactctctaagtgagaaaaacaagtggacatagcagaaatcctatataaatttatcataacgatatttacagcaataaagtcatctgcatttacagaagattttattgctgttttattaatgattagaaaattttttcttcagtatctaatcaggaaataatatttggaaaataaaagagaaagtttcattcttaaattagaattatagcgtgactggagaaattatgtgtatatggtgattagggtgagaaaatgataagatatttaaggcgtgtaaaaaggttcggtaatatgaacgtatatcatattttatttaaatatggtatacttttatcatgggtatttagcttcaaaaatgctttaatgcttaattattgtaattggataaaatgtttttctgtactgaggagaaggtaaggatggaagtaaaggtatttgataatattacggaaattgctcgtgatgatatggcatcaacaatagaaaaaggtagcaaagtatctattgcagctgcttgtttttctatgtatgcttataaagagttaaaaaagcaattggaatctgtagacgaatttcgatttatttttacatctccgacatttgtaactgaaaaagcagaaaaacagaaacgtgaattttatataccacgtcttaatcgagaaaatagtctctatggtacagaatttgaattgaagttgcgtaatgaaatgacacagcgtgcaatcgcaaaagaatgtgcagaatggattaaaagaaaggcacgttttaagtctaatacaactggtgaaaatatgggtggatttattacagtagaaaataagatgaatcaacttgcatatatgcctatcagtggatttactacggtagatattggatgcgagcgtggtaataacagttataatatgattaatcgttttgatgccccattttcgatgtcttatatacaactttttgagaatctttggaaggacaaggaaaaattgcaggatgtcacagatgttgtggttgaaaatattactacagcctataatgagaattctccagagtttatttatttcatgacattgtatcatgtatttagtgaatttttggatgatatatcagaagatgaattaccaaatgaagcaacaggatttaaacaaagcaaaatttggaatatgctttatgacttccaaagagatgcagtattagctattattaataaaatggaacgctataacgggtgtattttggcggacagtgttgggttaggtaagacatttacagcattggctgtcattaaatattatgaaaaccgcaataggagtgtacttgtcctttgccccaaaaagttagcagaaaactggaatacatataaggataattatattaacaatccgattgcttcagatcgattgaactatgatgttctttttcatactgatttatctcgtgcacatggattttctaatggattagacttagaacgtttgaattggggaaactatgaccttgtggtaatcgatgaatctcacaattttcgtaacggtgcaggtacacatgcaaaaacacaggaaaatcgttatgtgaaattgatggataaagttatgcgtgccggtgtgaaaacgaaagtattgatgctatcagcaacgccggttaataatagatttgtggatttaaaaaatcagttggcgattgcctatgaaggtgattcagaaaacataaacaagaaattgagtacaagtaaaacgatagatgaaatatttaaacaagcacagaaagcatttaattcttggagtaaattagatgtagcaaaaagaacgacagaggcgttgcttcaaatgttagatttcgatttctttgagctgctagatagtgtgacaatagcacgttctagaaagcatatcgaaaagtattatgatactactgaaataggaaaatttccggagagaaaaaagccaatttcacttagaccgaaacttacggatttgaatgctgcaattaattataatgagatatacgagcagttgatacatttgagtctttgtgtttacacaccatctaattatatatttccaagtaagatgcagaagtatttggatttaacacataataaggggatgaaccttacacagacaggacgtgaggaaggtattaggagattaatgagcatcaatcttttgaaaagattggaaagttccgtaaattcttttcaattaactttacagaggatgaaagcattaattgaagatacaattacagcaattaatcgatttgaaaaatatggaaatgtaaacattaatatgtatgaagtttcagacgaagattttgatattgatgatgggaatacagaatattttacagttggaaaaaaagtgaagattgaacttgcagatatggattacaaaacttggcgttcagaattaatagaagatgcggagacactagagcttttgacattaatggtagctgatattacaccagagcatgattacaaattgcaagagttgttacgattattagatgaaaaaattgaagatccgataaatccagataataaaaaagttttggttttttctgcgttttctgataccgcagaatatttatataaacatgttagcaaacatatcaaaaataagtatggacttaacacagctgtaattacaggaagcatagatggaaaaacaacaattgcaggttttaaagcaactttaaataatgttttgacatgtttttctcctatatccaaagggagaaatatattaatgcctggaagtaatacagaaatagatatattgatagcaacagattgtatttctgagggacagaacttacaagattgtgattatttggttaattatgacatccattggaacccggttcgtattatccagagatttggacgtatagatcgtattgggagtaagaatgaatatattcaacttgtgaatttttggccggatatggatttggatgaatatattaacttaaaaggacgtgtggaaacacgtatgaaaatttctattatgacttctacgggtgatgatgatcttataaatccagaagaaaaaggagatttggaatatcgtaaacaacagttaaaacggttgcaggaagaggtagtagatattgaggatatgactactggtatttctatcatggacttgggcttaaatgaatttcgacttgatttgttagactatgtaaaaatacatccagatttagaacaaaaaccgaaaggtttacatgctgtagttccgtcaagagaagatttaccagaaggtgttatatttgtattgaagaatattaataatagtgtaaatattgataatcagaatagaattcatccgttttatatggtttatattgggatggatggagaagttatttgcgactatttgaatcctaaaaaattactagatgatatcagattgctgtgcagagggaaaaagcagccaattaaaaaactttaccaaaaatttaatgaagaaacagatgatgggaagaatatgggcgagatgtctgaacttcttagtgaagcgattaattcaattattaattgtaaagaagaaagtgatattgatagtttatttgctgaaggaggtacatcagctcttttatcagccgtatctgggttagatgattttgaacttatatgttttcttgtgataaaataaaggaggttggtgaaagaatgataggattaccaaaaacgacagagtttaataaacgaattccaaaacaaaaattttacgaaaatataacgatttcaccagcaataaaaagagtatttgtagaacaggttaaaacaatatattggaaaaacaaaatagcagtttcaactacaaatcttgcagagggaaataaggtaacagaattagaagtttttgaaattcatttaaacaatccagaattagatgaaaaattactttaccagatagataaagtagtaccgtatcatatcttatttttactagaatatcaaggcgagtaccaggcatgggttggatttaaggagaaggctgcatctggaaataaagtatttaaggtgaataggtattatcatacagaatggatgaaagaagaagaattacctctacatctggaaggactgagcatggatgcagcttatgagaattatgttagacagattgcaggagataaattacaaataaaaactaatggtgaaagtttaaaagaatctgtgactagagatgaacagagacagatattgcaaaaaaagattgatattttaaaggctcaaattcggaaagaaaagcagttgaataaacagatgcagataaatagagagttaaagatattaaaaaaagaattagaggagtatttataaacatgggtgttgaacagtatcagagaaaagtaaactctttagataaagagattgctgacttggagaagaaaaaagcagaagaagatagaaaggcagcggacaatcataaaaaagcatcaagagtaagtgttagcaaaaatgcctctgaaagtatgataaagagtaaaatgcgacaaattgaaaattatgaggaaaaagcaagaaaagctgaagcagcgagtgcagattatggtaaaaaaatttcagataaacgtacgaaaagaaatgatgcctatcttaaacttcaaaaagaagagcaaaacgaacggaagaaacaggaaaaatcaattgaaaatatgaaacgagtatatgaacaacgtatttcggaattggaatcattacggttatctaaagttaaaaatgaatttttggaaacagtttcgggggatgaacccgaatatgacgtgtttgtttctcacgcttgggaagataaagcagattttgtagaagcctttgtgcaagctttgaaagacagagaaattaaggtttggtatgataaatcaaaaataaaatggggtgattctatgagagcaagaattgatgatggattgcgtaaatctaagtttggggttgctatattatcgcctaattatatagctgagggaaaatattggacaaaagcagagctagatggtttatttcaaatggagagtatcaacggcaaaacgttacttcctatatggcataatttgacaaaaaaacaagtaatggattatagtcctattttagctagtaaattagcaatgacgacagccacaatgacggcagaagaaatagcagatgaattattagatatgctttcatctgaggaggataaataagatggataaaatgcggatggagtcagtagatatgactgctcagaatattgaaaaaattggttctctatttcctaattgtataactgagactattgatgaaaatggaaaagggaagaaagtgattaatttcgaacttttaaagcagatgctttcatcggacgttattgatggggatgaggcatacgaatttacttgggtagggaagaaagcatctattgtggaagcaaataaaccgattcgaaaaacgcttcgcccatgtaaggaggaatcagtcgattgggataatacagagaatctctatattgaaggagataatcttgaagtgttaaaattgcttcaggaaagttatttaaataaagtaaaaatgatttatattgatcctccatataatacgggaaatgattttatttataatgatgattttaaaatgacaagtgaagaatatgcggaagaaattagtgaattagatgaagatggaaatcgtatgtttaaaaatactgatactaacggacgctttcattcagattggtgttcaatgatttattctcgccttatgcttgctagaaatttattgtctgatgatggtgtgatttttatttcaattgatgataatgagcagtccaatttaaaaaagtgttgtgaggaaatatttggtgaaaagaattttgttgcacaattaatatgggaaagggctttcgcacctaaaaatgatgcaaaatatatttccaatagtcatgattatattttaatgtttgcaaaaaatattaacaattttgtaataggaagattacctagaacaagtgaagcaaatgcgagatattcaaatccggataacgatccaagaggtgtatggcaatctgataatttaactgtaaaaacgtattcaccgtctggagattattctattactacgccctctgggcgggtagtagagcctccagcagggcgctgctggagtctctctaaaaataaatttttagagagacttaaagataatagaatttggtttggtgcagatggaaatggagttcctaggattaaaagatttttatcagaattaaaatttgaaggtatggcacctacatcattattatttttcaaagaagtaggtcatagtcaggaaggttcacaagaacttataaaaattatggatggggagtttttgatgggccaaaacctactcgattattaaaaagattaatgatattagcaaatctaaaggaaaattctatagtattagatttcttttctggatcagcaacaacagcacatgctttaatggaagttaataaagaaaaaaatttaaagtgtaaatatattatggtacaattagctgaaaatactaataaaaagaaagatacaggctataaaaatatttgcgaaatcggaaaagaacgtatccgacgtgctggaaagaagataaaagaagaagctccattggtcacacagaatttagatattggtttccgtgtattaaaattggatgattctaatatgaatgaagtatattatagtccagatgactattctcagggatttcttaatcaattggaatctaatatcaaagaagaccgtacagacctagatttgttatttggatgtctattggattggggattgcctctttcattaccgtattattcagaacaaattgagggatgtacagtccataattataatgatggtgatttaattgcgtgctttgatgagaatattcctaacagtgtaattaaagaaattgcaaaaaaagagcctcttcgtgcagtgttccgggatagtagttttgcaagcagttcgtctaaaattaatgttggtgaaatctttaaattaatagcaccggatacaactgtgaaagttatttaaggaggcaaagaatgaagttacgatttaaacatcagaaatttcaggctgatgcggcaaaggcggtggtagatgtatttgcgggtcagccatatcttacaccttcttatatgatggataaaggttatcagggaaaaacaatggaaggacagaaatattctcagatgtctacgatggatgaagaggattttacgggttggagtaatcataaaattgttccagagttaaatgataggttgattttggagcatatacagaaaattcagcgtgaaaatcaaatagagccatctggcaaattggaagggcgatataatcttacaattgaaatggaaacaggtgtgggaaaaacatatacttatatcaaaactatgtacgaattaaatcgtgcatatggttggagtaagtttattgttgttgtaccaagtattgcaattcgcgaaggggtctataaatcttttcaggtaacgcaggaacattttgcagaagaatatgggaaaaaaattcgattttttatttataattctgcaaggctgacagaaatagatcgctttgcgtcggataattcaattaatgttatgattattaattctcaggctttcaatgcaaggggaaaagatgctagacgtatttatatgaaactggatgaattccgttctaggagaccgattgatattcttgcaaagacgaatccgattgtgattattgatgagccacagtcagttgaaggtaagaaaacaaaagaaaatttgaaacaatttaatccacttatgacattgcgttattctgctacgcataaaagagatagtatttacaatatggtatatcaattggatgccatggaagcatataataagcgtttagttaaaaaaattgtagtaaaaggcatttcagaatctggtacaacggctacagaaagctatgtgtatttagaaagtatcaatctttcaaaagctgccccaacagccactattcaatttgattataaaggtgccaatagtattcgaaagattactaaaacggtaggagaaggatgtaatttatatgataattccggaaatatggaagaatataaagaaggttttgtgatttctagaattgatggacgtgacgattcagtggagtttattaacggtattaaaatttatgctggggacgtaattggaaaggtaagtgaagaccaactgcgtcgaattcagattagagagacgattctttcacatatacagagagaacgtgagttattttataaagggattaaagtattgtccctcttttttattgatgaggtagctaagtataaacagtatgatgatgcaggtcagccaattaatggaatatacgcagacatattcgaagaagaatataatgatattattaacaatcttcagataaagattggagaggatgattatttaagatatttatcctctattccggttaataaaactcatgcaggttatttttctattgataaaaaaggcaaaatgataaactctaaggttctacgtaagaaaacaactacagacgatgtagatgcatatgaccttattatgaaaaataaggaacttcttttagataggagtccagaaaaatcacctgtacgatttattttttcacattcggcactccgtgaaggctgggacaatccaaatgtatttcaaatttgtactctaaaacagagtaatagtgaagtaagaaagcgccaggaagtaggtcgtggacttcgtctttgtgtaaaccaggatggagaacgtatggataccaatgtacttggaaatgatgtacatagtgttaatgtactgacggttattgctagtgagagttatgatagctttgcaaaaggactacaaagtgaaattgcagaggcagtagctgatagaccacatgcagttacagcagaattatttattggaaaagtgattgaagatgagcaaggaaatgagcaggtaattacttctgacatggcacatgcaatttattatgatttgataatgagtaggtatgttgacagaaaaggtaatttgacagacaaatattatgaagataaagcaaatggagaaattaaggtggcagaagaggttgctgattctgtcaactccgtaattcaaattatagattctgtttataatagtcgttctatgtgtcctgaaaatgctcgtagtaataatatagaactacatctagatgaaaataaacttgcaatgccagaatttaaagcactttggtcaaaaataaattcaaagacagcatatgttgttgattttgatacggaagagcttatatgcaaagcgattgactctttggatagaaagttaagagtttctaagatttattttaaagtggaaactggtgttttaaatgagattaagtcgaaagaaatccttgctgatggaagtggttttctaaaagaaaagacagaaaattatgggcgtacagtgtctgttagttctagagttaaatatgatttgattggaaagttagtagatgaaaccaatttgactagaaaagcaattgtacgtattctgcagggaattcaaccttcggtattcaatcaatttaaggataatccagaagaatttattattaaagctgcagccttgattaatgatgaaaaggccacagcaattattgaacatattacttataatgtgacggatgataggtatggtacggaagtgtttgcagatccgacgattaaaggtcgtcttggtgtgaatgcaatgaaagcaaataaacatttgtatgaccacatcatctatgattctactaacgaacaaaaatttgcagaagagttggatataagccaagatgtggctgtttatgtgaaattgccagatggattttatatttcgactccagtaggacgatacaatccagattgggcgattgcattttatgagggaacagtaaaacatatttattttgtagcagaaactaagggttctatggactctatgcaactgcgtttgattgaaaaatcaaaaattcattgtgcaagagagcattttaaggcaattagtaatagtgaagtagtatatgatgtggtagacagctataaatctttattggatattgtaactagataaagacattataaaaaggtaggttataatttcaggtattgtgaggaaataagatgggaaatgtaaaagctacgttggttggagtaagtaattatgataatcctagaactccagatatagatgcttgtagaaatgatatagtggaagtaaaggcagcattgataaaaggcttaggtatttcatcacaggatattcgtttgttgggaagttctggaagagttaatataaaggaattggaaactgaattacaaatagcatcattagttgttgagccagaggatacatatattttttacttttcaggtcatggaaataatggaactcttgctcttagtgaaactgtgattggtgtacaggaagtgatagaactagtagataacatagaggcaagaaataaaattattatattagatagttgtcgttctggtgattttttgattcctcaaattaaaacaccggatatagatagaatggtggaagagtttgcaggtgcagggtatgctgtaatggcttcctgcggagcaaatgagaattcaactttttatccgggaaataaaataagcttgtatacacattttttgtgtgatgcattaactatggactgtataataaaaaagggaaaaaagtctctcgaagagattaatgaattaatttttcgaatgataagtgtatggaacagaaaaggtgtcagaattcagcatcctatttttagagctaatataacaggaactatttattttccagttcaaaaatatacatcgtatcaaaaacaaaatatatttaaagaaacagaagaatatattatatatgaagttttgccatttcatcattctcgacagaaaaggtatactgctaaagttattttgaaatattattttgatgaaatagatattgtgaagattacaaaagaaataattgatgaaataaaatattcaaatgtctataaaaatgaaatagaagagcgtagattcaggggattaccggccaatatgatacgctgccatatgggaaatgatgagcaggatatgacagattgtaattttgaatggattactacatgggttgatgatacgatggacaagaataattggtatagagaaagtaatggttcaaaaatacttgatggaattcttgtggataagcagaaatcatacaatgcattgcgaatattaaatcaacaaactgtgaccacggaagaatttattaaagaggcaagaaagtatttaaatgagatggtagcgtatgcggatcaattcataagtaaatatagagaatattctaatggtaatatttcggaaagtgaattagttaataatgtgaaagatataaatgtacaaatagcatctatatattttaaaatttcagatttacctaaagtacctttggaatgcaattcatgggcagaatcaatacaacagatagctgcaacgattcatgattttacactattttatagtaataagacaatgaatacttggagtcaagaaaatagaaaagatctcatgaaaattaagataaaacattatcagcaagaaatagaattgataaagcaggaagagaaaaagcttaaggaataaaatctatataaaaaagcatgaaaagaggtgtttttttgaacgaaaaagaatttagtataatactttcttcaggagaatcattgcatacagaatttaaatcatggaaaaaagcgggtaacatgaaagaacgtattaagcttgctgttgatgaactagttgctttcgcaaatgcaaagggtgggaccgtttactttggagtagaggatgatggtacagtaactggatgtgaaaaatacgatacacaaagtattattgaggcaatatatgataaaacaagaccatcgttatttgtggatatagaaaaaattccttatcaaggtatgatggttttggcattgaaagtagaggcagatggtaaaacttatgggacaacagatggtcgttttttgaaaagattgggtaagaattcaaaacctttttttccagatgaaatgtcgcatcatttttacagagagcagataccggatttttcaagtaagatagtgatggaaagtacttttgaggatataaatcttttagaagtatattctttaaaagaaaaactaaaaattagagatccaaaatcaacacttccagctttggaggatatggcttttctaagagatcttggacttattaaaaaaatagataatgttgaaagattgactgtagctggtttgttatttgttggtaaacaaaattctatttcaagattgttgccgcaggcagaggttatatatctacattatagtgctgaaaatcttgaagaatatgatttaagattagatttacaacagccaattgtaaatgtattagatcgcttgacggaaaaaatacaaaatgataataaaattcttaatatccaggtgggattatttagattagaagtagaagatttctctgagaaagtatttcaagaagctttattgaatgcattgtctcatagggattatgaaagtatgggtgcagtatatgtaaagcattatcctgataaagtagttatagagaatcctggtggatttttagatgggataacagaaaggaatatcattacgcacccctcagcaccaagaaataaactaatcgcagaaactttgcaacatttaaaatatgtacaaagaactgggcagggagtagatattattttcagggaaatgatatctatgggaaagccatatcccgaatatcaagtgtttagtgatgcagtatcattgacacttcgtagtgcagtggaagacgtatcgtttgttaagtttattgtaaatgagcaggaaaaaaatcaaatatttttatcattggcagagctaatgattatgcgctatttatcagagaataaacgcataaagttatcggaagcaaaagatttgacacaaatttctttagaaaatacacgtaaggcattaactaacttagttaacctgcatcttatcgaatctgttggaaaagaatatatgttaacagcaagagtttatgaggccgttaaaaatgatttacaatatactcgtgacaaaggagttcgttatattaaagcaaaagaaatgattctagaatatcttgaacataatgaatctattacaaatgcagcgattcaagagttgtgtggctttagtaaacagcaggcaagaacaacaattgacaaaatgagaaaagaaaagttgattattttagttggaaaaggaaaccgttcctgttatcaacgtattgtatatgaaaataaataatcgagtggccctcgagttttcactcgaggaccacttgagacagaaaaaactttcacactctccggtaaatcatgagtaccaaaaatctatgctttttgatgataattaattgatgcttgaaaaaatttaattaacggataatggatagtaattggcattattgggtcaatatcagtatcacctttaaacataaatctagaatttgaaccatagttaccaattattcctatatcgtataaatcttttaatatttctggtgtttttcgtttagtaactaactcgttcacttcttcaaaaaaatcttttttgctattcagatgatgctggaaatccgaaactgaaaaaggcaaaagtattcctgtcaatgatttttttattccctctacttccttatcactatattttacagttaaaaactcttcaaattcagtccatgattcttcggcataaggttttcgcgaggtatcaaaacattcttgatcaataatacttttatttccatgaaggcgttggatagtagtaaaaagtcttattatatctcttggtttataccatgtctgatcaagtatataattttgtacttctttttttttatttccaacatatggtataaaatatgtttcccaaatatcgggagatggttcaagccctaatttggtttcgctaaaatgtattcttttttccaacatctttaataaagggtgatttctgatatttcctcctttttgttcccatgaaatagtaacaccaaaatcatgaatagttttatttatttctagtcctttggaaattatatttttgtatacttcactacgtattgcggtaactaagaaaacgttgaaattatgtgttctattaatatcggataagtattctatcgcaaaaattaaatcccgaattaaagtgacatcacgttgatatttttttgtttgtttaaaagccaattcaagttcatcaataaaaatatagattttatcttctacaggagttaaaactgaatataggttaataatttgtttggccaaagatgtaaatgatacagactttttttctgaatcaacccattcaaattctaaattggttttagctattttgttaaaatcaatttcaaggtttccacgtttcattttgggaagtatttttttaatagtattatctgttcccaatttaccataggtagcattaagtaatgcacataactttgtccatgattcagtgttgcgattgaatacaccatattctgtccttgaaagtctggatacgattactttaattaggtaaacctgccatgcaagtgaacagttcaatgtgaaatcactagggatttcactgtctataatctcttcgaaaggattgttggggagagcagagcgttttatttgattacgttcttcttcatctacatctcttttaaaacgaataaattcactaaaattttgggacggattttcggaaattatactttcaagatatttgagaagcatagttttaccagtgcctttgtttccaaatatataatatgttgatccatcaagcagtcgtgagatattaatattgggaaactcgtaaaaaagacctttgcaagtgtcttgtccatattcaagaaattcgttataaccgtcaatttttccaaaataaatatccttaatttgcaattttcgcatatagattctcctctataaatattaatgttgattttatgataattaaaatccagaatttaaactaatttggtccattatcttgtcatgtttcttttgcattttaagtatttctgtcaaaggttccgactctggataaatatccattcaaaggttaaattccgcttcaacttttagtaaagcttccccacgtttcttaacatcttttattttattgcatttttcaacttctatcatatattcattataacaatctaaccataatcgcatcaaagacaatgttccaaagttgattccaaccatatcatttccagctttatccgtgtattcaaagaggtgtccgtcatattaccggaatatctgaaagagtctgtgaatcacctttatactatcaaaatcagagtttgtcaatacttcgggcttgacagataaagcgtctgctatttttttaaggggatggtttggtatttcttgtaccactttcgtaggcacgaatgtaggcttcacttgcaccaaccatttctcctaattgtttttgggtaagattacgttcttgtcgaatttgcataatgaaagtgagcaaaccaacatttgcaacattcatgaaagaaggtgtctcctgcaaatactatacatcattcttcatttatatacaaccaatttaagtgtttgagtttatgcaaattttattctaatcaagtgataaaatacctcatgagcatcctgattagtattttcatcttaggatatcatgggaaatacaagggcttttctaaaaatagtttctgtcacagaactacaattgctcatttcctcaattctggaaaatgggacgaatccttacttttaaatgtattaaaacaatatgtcattgagattctttattcagaagcagtccgcatcgggcccccctgttttctgtattgtagatgatacgatagcttcaaagacaaagcttttgtcacaggctctgtatccgattaaagatgcatatttttgccaatcccatttaaagggaaaacaggattacgggcatcaggtagttgctgtatgctttcctgtaatggcattgttctgaattatgcttttgtaatgtacaataaatccatttccaagattgatattgtacaaaacattgcaaaggaactgccagttcctccagttatgttctactttttttgtgactgctggtatgtttctgaaaaaataatcaatacctttgcagtaaaaggatttcatacaatcagtgtgtaaaaaacaaaccggatgctttatccttttgaaatcaaaaagaaactaaataagtttgctactcttttattggctgcacattctgattttcaacttgtgacagtgaaaaacaaaaaatactatgtgcatcggtatgagggaaaaatcaactgaaaatgccatagttcttttaagctatcctgaaaaagcatttggaaacccaaaagcatctaaagatattggctattaatgtcactagaatattatatatgtgttatcggaacaaatgaagcctgttcttttgagaatggatatactcaaatttgtgacatcatatacgaggaaaaatatcgatatatttttcagtgtgcaaaagcaagcagggattttgaagcatttatgaaattggcgatatagttttgtgcaattttttgaatttactcacttatagcatatatattgaatcagacgctatctcatggtcacgcggctgaaattttggaaataagaaaatcagagttaattgatttgtatgataaacggggatattcttattttgatatgacgatggatgatttggatgacgaactgaatacattcagagaacttaaaaagaaggagactatggtatgattgttatctctgatacaacaccgctgatatcacttcttaaaatcaatcgaatagatttgctggaaaaattgtttggagatgttctgattccacaggcagtatttggagagttgacaattgatgagcatttccaattggaagccgaccagattagacagaagaagttcatcgtagtgaagcctgtaaaagatgctgttaagcagactgaaagactaaatgtatcgtttaagaacaataattgacaaaaagagaaaagaaaagttgattattttagttggaaaaggaaaccgttcctgctataaccgtattgtatatgaaaataaataatcgagtggtcttcgagtggaactcgagttttcactcgagagccactcgagacagaaaaattgtagatagaacatcacgtttatcaaaatgataatgtcaaattccctgctcccaattatctataaaatgtctacaaaaacagcaatagaagtgtagatatcatggaatatatggaatctgcatactaaatatatgaaaaatgaaatcaagagaatacaatatatagatgactacatagagtttgagtagcaacatatttcagggcaaacagttttatccagtttcagggcaaaactttcagccagtgaaatgacaaaaatcatgtgaaaacatgaaatgcaatttagaataaagaatgaccttgatggtctggaatttccagactgtcagggtcttttttcttatctggcagcagttttctaggatttgaaaagtggagaaaagccttattttaagggattttagaggtctggaaagtgacataaaattttaattttatgaggacatctaaaaacggaagcaataagaatataaaagaaagtctggatgcaatttctgttattttgggaagaagagttttatgatttaactactctgaaggataaaaactttgccctaaaataggatgaaagcgtatcggtatatcagattgtgcttacaagtggtttatggcaggagatttttctgtgaaaggcgagaatgccaacaatgttatagacatagatgataatgattgtaatacgacgaagatagaaaaacagaatgtatgtttgtgaaagagtgttgaaaaagggagtgtgctatagtataatagcaagaaatagaaggcttgtaggtaggtggaatatgctagaaaaaattatagagcttacaaacgaatatatagagagtatgccgaaaaaagaacgtaaaaaatatggacagttttttaccagtatggaaactgcccgttttatggcgggattatataagttggatgagaaaacaggcagagtaagtgtgcttgatgcaggggctggttcaggtatattatcatgtgcttttattgagcgaatggaaacaatagattctattcaggagattgagcttacctgctatgagaacgatgaaaatgtattgccattgttgaaacgtaatctggaatattgtaaagaagagacaagaaaaaaacttacagttaatatcgttgaagataattatattttgagccagtatttggattttaatcatatgttgggaggaaatgcggagcctaagaaatatgattttgtgattggaaatccgccgtatatgaaaattccgaaagatgcgccagaagctacagcaatgccagaggtatgttatggtgcaccgaatttatatttcatttttgcgtctatgggattatttaatttatgtgaaaatggagagatggtttacatcattccaagatcatggacatcaggggcgtattttaaacgtttccgggaatattttctgacagaggggaaattggaacatattcatctttttgtcagcagaaataaggttttcgacaaagaaagtgtgttacaggaaacaattattatcaaagtaaggaagacgagtgaaaagccagaaaccgttacgattacatcatcgaaatcaaatagtgattttggggagctgacatcattaacagttccgtatgatctggttgtagcaggatcagattattatgtttatcttgtgacagatgaaaatgaagtggaagtattaaagaaattgcataaatttgataagacacttccggcaataggagtaaaaatgaaaacgggattgaccgtagatttccgtaatcgtgatattttgagggatgaagcggaagagggggcaatacctttattttattcacagcatataaagcaaggaaaggtagaatttccaatccagaaagaacatgaatatgtggtgacagaacaaaagggattaatgcaagataacaagaactatctatttgtaaagcgatttacagcaaaggaagaaccacgaagattacagtgtggagtatatttggccaaaagatttccgcagtatcaaaagataagtacacagaataaaattaattttgtggacggtgtattaacggaaatgtcagaatgcctggtgtatggattgtatgtattatttaattctacactttatgatgaatattatcgtattttaaatgggtctacacaggttaattcaacagagattaatgcaatgccggtaccagatttagaggacattcaggaaatgggcagaaaagtgcttaaaagtaaggattattcggaggaaaattgtaatttgatattggagggatactgtggataagaaaatagaagaagcaagagaatttctgcaaacaataggtatgccaaaagcacagcaagcggatatatgctgctatgtgatactggctatggcggggataaagccggatatgtcatggagtgaaggaacaaatgaatggattcgtattcatgatattattcagtttgttaatacattttatggtatgagttatgcggaaaacagtagagaaacgtttagaaaacaggctctgcatagatttcgtaccgctgctttgatagaggataatggaaaagcaactaacagtccgaattatcggtacagattgacagaagaaacagtgcaaatactaagaactatgggaactccaaagtggaaggaatctataaaacgatttctttgctaccatgagaagttaattgatttgtatgcttctaaaaagaagatgacaatgatgccggtaaatataaatggtgaaagttttaaattctctacaggtaagcataatgaactgcaaaaagccattatcgaggaattttcaccgagatttgcaccaaattctgaatgtttgtacgttggcgatacaatagaaaaagatttggtaaagaatgtagaaaaattaaaagaactgggatttgaaattacgttacatgataaaatgcctgatgttgtattgtatcgggcagataagaattggatttattttgtggaatctgtaacatcggtcggtccgatggatccaaaacgaatattagaaattacagagatgacgaaagatgtaacagcaggaaaaatatttgtaacagcatttctggatttcaagacgtataagagatttgcggaagaacttgcatgggaaacagaggtctggattgctgaaatgccggagcatatgatacatttgaatggtgataggtttatggggccgagatgatagtaaaaaaaagttaattacaaacaacttgctcgaggagatatttgtaggtttcgtaacattggcctgcatcaagtttaaattatttgtcatgttgttttgtcataatgagattctctgccagtatagtttaccgtatgaatcctatctatatttggatttatcatttcggctagtattgtttgatttatattttacagcagagttatagtggatagaatgtgcggaaagaggaagtgtaatggagtttttatcggagatagagatgtttagggattctttttataacggtgattcaaaaagtgaagtttctgttgcagttgaagaggcaaaaaaatatgagatttttaatttgatttcaagagtatctgcattgaatttatttcatcaaaatcaaacgaaatcggtcattcttgatacatatatagaaggtttattacatcaaaaaaaagatcaatttcaatctaaatataacattagtccgggaaaatttcggagaataattactcagatatcagatactagtttgaagtattcagttgatccaccagaaaatatgttcgtgcagaatattatgttttatggaaattatagagttttaaatggtattgatcagacaccagcatataatcttcaaaacatgatttcaattttgtttacaaacggaatcgaatatccaaaagactttttgaatgaagcatatatcttagttaatggaatgctaacaatatctgaaaagattgtaagtggaatttcagatataaacaacgatcataacacagatgaagaaaaaggtgtaataataccaccagcgatagatttaaataaatatgctgaattaatcgtcatagaaggaacaaattttcgaaaactatttttggaaaaatcagaattacttaatttaactacaatagaatttggagttgaatttgaggatgattttgataataaatcattttatactcgtccattcctgtataatgaagagcaagatcagtatatcctcttaaatgctggtttgcttccaacagctattgtattttggattacttgtttagctaagaaatatggaatatttgaaaatgtcatggaaaattataatagttatatttttcatgagtgtaaaaaatatttacgttatcttggacacaaaaaagtgcttgaatcacagatgggaatagagttatttaactgtagtggatataaggaatatattgcatctgtacagaataatcagttagtaatcgtccagtatttgtatgatgatggtaagaactatgatgcgtatacattgcattctcctgttaacaaaaaagaatttaatgacatggtgcctgaaagattagcttatcattattctaaaatagttgaatatggtgtaaacaaagaagatatttttgtaataattataattaattcacttgggcgtggaattgcatatggaataaagaaatatgattatttttatcctccgttaagagttaatccgtttgaacttatgtgtattagtatcaatgaaaaaacagaaagcatatttataccaagatatttgaaagcaaaaaatagtttacgaacatttgaaacgggtatacttagtgaattgaatcaaatagaaatgtattgtaataacaattattccttttatatgaatgatgactttgcaccgagtgagattacaacatattttgcgccgggagattcgttggactatataatgcgtgccatacaaaaggaggatagacggcttgttgaggattctcaaggtatcatgttttgtgaagttattcttaatgataggaaaagaaaaatatatgtagatcctaattgtataaagcgacaagaaatcagttactatattgaatttgacacttttaatatatggatagttgcaaaagagatttcaaatgcaaaaaaaatggatttgtgttattcggtattagatttgatatcgtactggttagctgagtgtaaaacagttttgaataaaatgaatggaggtgggcgtacttacgaaattgaaattattttatcggatgaagctgagaaatattattattacaaagaaaatccaaaaccatttattgaaacactagaaatatgtaactctttttcggtaatggaaatatgtatttcaccagaagcatttcaatacttgaattaccgtgataattcaagagaaaaggaatttattaccataattattgattatatttataaattattaggagaaactggtaaaatcaattatgatttaaatgtattatttgccaatccgatgcaaaaaaagttattttctttagattatcaagagtatcattatcttgagcctgttgcaaatcgagaaaatcattttgtgcatggagaagatgaagacatactattgaacgaaattggtgaggagcttcttaaaatagggaaatggaatgttggcatagtagatgatggagagagaactcaaattgcacatgaggttgttggaattctttatagaaaactttaacaagaggtaggtatattaaactcaagaaatcttatagaagtattatatgatgatttggaaaaggttctattcaaacttatgttgtctcaaaaaagatacgcagaagatattgcttgttatccggaaaaggagcaagaaatatttgaacagacaaatagagataataaagcttctatagcattaaaatttcttattgaatatattgctgctgtaccacctaaaggaaatataaatattggcgagaatcaatatgaacgattgatagcaatatgttctttgataattgaatggtcgtacaaaaatgatttgttttattatcagatatttaatacaccaatagaaatattgaaatctcatcgtattggaatgagacaacaagaatttcaacatatgttcagtgttaatgaagcaattagaaaggaacaacttattgcatcttctgtttttgaggattcggttaatttagttgagcaaaagagctttatggaagaaattaatcgggcttttgaaaaagaatatggatactcgctttatcagcttatgcttttggcagaagggctgagagaatatagcaaaagtcaaagtagtgatacagtttatgtcgcaaaaatgaaggatattgttgatttcttaagccaatatgatacaagtttcaatgaagatacggtagatgtgattattggttcaatagcactgaggcaacgagaagactttcttgttccgccagagtcgtttagaaaagaggatgtatatccgtggaggtttaatagagagttatcatttactagacgcccgatcattattcgtggagatgaagtgatttggggaaatagacaactagatcatatgataagatttacagtgggcttaattaataatggtaaattaaaagcgcattctcctgaaatgaattcattggtagggaaaataagtgatgaaagaggagccgaattcaatgatcttatatataagttattaattaatcttaacgtatttgaagtatactccaatattagcaaagttaatggaattcacatatcagaaaataataacacactaggagatatagatgtgttgattattgaccacgagtataataaaataattgcggctgaggtgaaaaattttaacttttcaaaaaatccatatgagatgcatttagaatataaaaagatgtttgaaaatacaaaaaagaaaaaaggatattatacaaaacattgtcggcgtgttgaatggtgcaacaaacatataggagacttcaaaaaacaatatggattagataataatgagtggaaggttatagggttatttattttaagtcaaccattggtgagtacagagatttatcataaagatataaaaatgttgacagaaaaagaattatctgtaagttccatcagagcactttactaattgaacatgggaatataaagtaaaggttgccagatatgtatttgtaatttataatgaagtggcaacaaattggcaacagaaaatcagcaagtcaaaataatatatgtaacagagatataataacggcagaaaagagataaaaactaaacagatatgtttaataacatcttcggacttgccgagtttgaatagcggactaaattgcgaaaaagcccataaataaaggctttgcgggctgtctggatgttccagtggagtgcaaatggagttaaaaaatatttttttctttgttttctttccggagttatctgagattttcgcaaaaagtaactatgctcagaaaatataattagtgtgaatatgaagaacagtttgttttgatggaaatattttccgtcagggcagactgtttttttataccctttttcaatgatataaacgtaagtggtagatagtccgtatctggattttacctccaaccagtgccataatagtcctaaagattattaaaagtcttaaaagttcagtactcaacttttaggactggacaggaggcattttctatgagttctatcaccacggctgttgctgtagattatcggttacaacaatgggctcagttagtgaaagactgtcagaaccgtcctcaggatatgacagttgaacaatggtgtgatacaaaaggtatctcaaaatcgaattattattatcgtttacgctgtatccgtaaagcctgtctggagcacgtccaagacaattctgtctcatgccagcaggtagttgaaatccctgaaaagatcactcaacagtccagatcggagagtccttccgatatctctattgaaataaatggagttgttatccacataaaagaagatatttcagaatcccttttggaaaagataatacgggtggtctctcgtgctaaatgatgctacttgttttaaaaagatctttattgttaccggttatactgatcttcgttccgggattgaccgtctggcagataccatacgttcttatctgggagaagatgcgatcgaagcggataccctttatcttttttgtggaaggagaacagaccggatcaaagggctggtctgggaaaatgatggatatctcctgctttataaaaggttagaagccggtcagtttcagtggccaaggacagaatccgaagttcgttctattatagagcagcagtttcgctggcttatggaaggactcacgactcatcccaaaaagcaggtgaaacgattgaaaaaagcaccggattatactttgtaacttttatgcataacgtagaaatttcagactgctttccaagtgggaaaagatcacttccttttctgtttttctttgtattctggaagccaggattgttctgtacaaagaaacaaatgatgtttttctaaaaaaagaggcattccgtttctcgtggcaggtatggctcctgtgaacgaaaaccttatagtcatactgacgaaaagaaggataagaaagattcgccagaagtgctgtcttctgctataataaagatagttttagaaagggaaggcctctgttatgcagatgaaatatacagaagaaaaactgaataccttttcgaaagagacactcattcagttgtttctcacacagcaggaacagctatcagagattgacgggaaactccagcttgtgttggaacagctggcagtaatgaaccagaaccgttttggaagaaagacggaacagatgcctgtaccagagcagctggcatttacagatgtagatggggaactggtactgtttaatgaagcagaggttcttgctgctctggatgaaagggaaaaagaaaccactgtaaaaaaacgtccagtaaagaaaaaaggaaaacgagaagaagacctttccgggataccggtggtaaaagtagaacactatctgacagagaaagaactggaggatctatttggaaaggcgggctggaaacagctgcctgatgagatatacaaacggtaccgttttatccctgcaaaagtagaagtagaggaacatcatgttggagtttatgccagcaaagagggagatacgatgaaaaaagccccacatccagcctgtctgctgagaggaagtcttgtatccccatctcttgaggcggccgtactcaacggaaaatacatcaacgcagttccatttgcccgtctggaaaaagagttcgggcgatatggacttgccatcacccgtcagaacatggcgaactggacaatcgaatgtgcagaccggtatcttgccgtattttatgattatcttcataagtatatctacaagagtcctgttatccatgcagatgagactcatgttctggtaagaaaagatggaagggaagccgggagcaagagttatatgtgggtctaccgaacgggagagaaagaaaaaaaggcagtgatcctttatgaataccagaagacgcgaaaagcagaccatccggaaagattcttaaaagattataaagggatctgtgtaacagatggctatcaggtatatcacaaactgggagaagaaaaagagggtctgacgatagccggatgctgggcacatgcaagacgaagatatgacgaagctgtaaaagcccttccgtcaaagagtcgaaaaagcagtattgcatggcaggcactggaacagattcagatgatataccatgtagataatacattaaaggagttaaaacctgaagaacgaaaaaaacgccgacagagtagtgtgaaaccactggtggaggcctattttgcgtgggtaaaagagaaaaaagcagatggaaggatctcagaaaagagcaaggcaggaagaggattgagttattcaatcaatcaggaaaaatatttaaaagtatttctggaagatggaaatgtgccgatggacaataatgcggcggaaagagcaatcaagaatttctgcatcggccggaaaaactggctgattatagatacgatacggggagcacagtccagtgccatcatttatagtattgcagaaacagcaaaggcaaacaacctgaaaccatatgagtattttgaatatttactggaagaaatatcacagcacatggaagatacagacttgagcttctgtgaaaatctgttaccgtggtcaacaagtcttcctgaaaagtgcagaaagccagagaaaaaataagaccgccaaaaggcggtcaaaatttagtcaaggtactcgctatctgccacttacatataaactccatggttcagtgataacacatatggaaactgtaaaattaagataattcgctaaatttcggaaaacgatgtccgattttgcatctgccagtacagagtatatgaagagataaatattcaaaatacaggaggtactgattatacatagatacagataatgagtatatgtattattattcggctgagtttgtaaaataagaatagcaaaagtgagaagaggatattacaaatcattgttttgataattcggtggtatcctctttgtggatttcagaatttgtttctcagctttcggtattctctcggcgaatatcctttcaacttgtgaaaaagccgactgaaataaagctggttatcatatccgacaatcttagaaatctcattgatggaataagttgttgtttcaagtaacatctgagcattgttgatgcggattcccacaatgaattgcattggtgtagaaccggtatattttttgaaatttcggataaaccagctgacactcatgcctcgtgaggtagcataatcattaatattgatattttgattgtagttttcactgaaaaaggtaacagcattatccatctcatgatcaagatattcattttttaatatgtgctctcttgtcagttcccggtggaagctgatcagaagatgacgtagcaaaaggacaagcatttcctcataattgtcttgacagcgttggagctcgataatgatacgtttgaaaatttgttcatattcattagatgtacccacttgaaagacacgttctttatccggaaacccatattgacgtaagatatttttcacattgcttcctgtgaagtgaatccagtatacttctgtcttatcttctccgtaatattcatatttttggagttctttcggtctgtacagtacaatgttgccggctggaacaatcatttcattatttacattatcaaaatgaaaatgcccacaaccagcagtgatatatataatctgataatccagacgaccccttggacggtaggtcggaagtttgggatgtctggaaagacggtaagtaccacagctaccgacaatcagcggacgacttttgtctttgaaatctatatgtgagtggttcaaataaccggtgttcaaatacataggacagcacctcttttcgtactttttatcattgtatcatttagtgcatattttgtctaatccaattcatagacatattttgcgaattaggataagctatatatatatatagcataactaaggaacgcaaacaaaaagtaaagtataaggtttgctttaggaaaacaaagaacaaaaaagtatatgtattggaggagagctatttatgatcgtaccacgttattatgaaaatctaagcgtactgcatgaaaacacaatgccagccagagcctattatattccggcatccagaagaatggataacttggtggaacacagagaagagtcagatcgtatgcagttattgaatggaacttggaaattccagtattttaacagcatctatgacattcaggattctttctttgagaagaattatgatacagaaaattttgatgagattcaggttccaagtgtatggcagatggctggatatgatacacaccagtatacaaacatccggtatccatttccgtttgatccaccatatgtgccacaggacattccgtgtggagcctatgtacatacttttgagtacagtagagatgagaaagcgccaaaatcttttttgaactttgaaggagtagacagttgcttttacgtatggatcaatggctcttacataggatacagccaggtttcgcatatgaccagtgagtttgatgttaccgatgtacttcaggatggaaagaatacggtggcagtgttggtgatgaagtggtgtgatggttcctatttggaagatcaggacaaattccgtatgagtggtattttccgggatgtgtacattttgaaacgcccaaaacaggcaatcagtgattatcatattaaaacaagaattgaggatatgcttgcgaaagtagaaattgaaatgaaattctactctccgttaaatgtaaaaatttcgattgaagatagaaacggagcagttgtagcactaggaagtattgctgaagaaggaacagctgtattagaaatcgcaagtccggaactttggaatacagaaaatccatatctatataaactgattcttgaaacagagaatgaagtaattgtagatcacattgcattaagaaagatagagattaaagaccaggttatttatttaaatggacagaagatcaaattccgtggtgtcaatcgacatgattctgatccggttactggatttacaatcaatccggaacagattacaaccgatcttacgttaatgaagcagcataattttaatgcgatccgttccagccactatccgaacgcaccatttttctatgaaatgtgtgacaagtatggattcatggtaatagatgaagcagatattgaagctcatggtccatttatgatctacagaaaagaagacactgattacaatcggttcaaacgatggaatgagaagattgcagatgatccggtatgggaagaggcaatcgttgatcgcgtaaaactcatggtggaacgtgacaaaaaccgtttctgtattgttatgtggtcaatgggaaatgagagtgcttatggctgcaactttgaaaaagcactggaatggacaaagaattttgatccagaccgtatcacacaatatgagagtgcaagataccgtaattatgatgaaacatatgattacagcaatctggatgtgtacagccggatgtacccagcactttctgaaattcaggaatatctggataaagatggaagcaaacccttccttttggtagagtactgtcacagcatgggaaacggacctggagattttgaagattacttccagatgattcaggataatgataaaatgtgtggcggctttgtctgggaatggtgtgaccatgcgattgctcatggaactgctgagaatggaaagactatatatgcttatgggggcgaccatggcgaagaaattcatgatggcaacttctgtatggatggattagtatatccggacagaacggtacatacaggacttttggaatacaagaatgtttatcgcccagcaagagttatttcctataacaaagaaagcggagaactggtgcttcataactacatggattttgatgacttgaaagattatgtgaagattagttatgagctgacacaggatggtcttgtgatcagcaaaggcatacttccggagttttctgtggcaccacacggggaaggaaaaacaaacctgaagatcaatgttccagagaatgggaaatgttatttaaaacttatttaccatctgaaaaaagaattgccactgttggatgaagaccatattcttggatttgatgaaattgaggtaagtaaagaggatacaaaatgtaaacttgcagagaaatggataccaaaaacagtagtggactctgaattacaggtaaatgaaaatgatacacagattcatatcaaggggcgtgaatttgcttataccatagacaaacgtactgcactctttacagagatgaaattcgcagggcgggaatacttgaaccatccgatggaattaaatatttggagagctccaacagataacgatatgtacatcaagtctgaatggaagaaagcccactatgataaggcttacacaagagcctatacgacagaggttgtgcagggaaaacatggtgtgaagattacaagccatgcttccgttgtggcagagacagtacagaagattcttgatgtgacgattacatggaaaatagaagctgctggaaagattgatgcagatattgcagtaacaaaagacgatgaattcccggatcttccgagatttggtgtgaggatgttcctggataaaaaactttcagctgtaagatactttggaatgggaccacaggaaagttattgtgataaacatcaggctgcgagccacggtttgtaccgggcagatgtaggggatttacatgaggactatatccgtccacaggaaaatggaagccattatgattgtgaatatgtagagattaacaacagccgatatggaattgtggcatccgcagaaaaggcattttcattcaatgcttcttattatacacaggaagaacttgagaagaaaacgcataattatgaattaatagaatcagatagtgtagtattctgtgttgactacgcattaaatggcattggttctaatagttgtggtccagttgtattggagcagtaccgatttgatgatgtattattccggtttcagtttacactgataccgtatgtaaagggataataaagtttcatgtaacccgtaaacaaggaaagagagtctgattgtaatgtaaagtccggatatacagagcaatcagacaaaatcggagaaaaaaacagaattagatatcatacggttagccatattgagattctaagtgcgatgaagatgaggagcaaagaaattcgatggaagaaaaaaagtatttgaaatggtataacaaaattggatacggatcaggtgatattgcaggtaatgtagtctatgcgttcctgacatcttttatgatggtctatctgacggactcggtaggacttgctgcaggtgtcgtgggtaccctgattgccgtatcaaaactatttgatggttttacggatatattttttggatcaatgattgacaaaacacacagtaaaatgggaaaagcgaaaccctggatgctatacggatatattggttgtgccattacgctggtcggctgctttgcaataccggtgagtttgggaacaacggctaaatatgcatggttctttatttcttatacactgttaaatggtgggttttatacagcaaacaatattgcttattcagcacttacgtcactgattacaaagaacagcaaagagcgtgtacagatgggatcttaccgttttatttttgcattttcaacaagtcttctgattcaggcgattacagttggatttgtagataaatgtggtggagatgctgcggcatggagaacggttgctattatctatgcaatcattggtctggtcgtaaatacgatttcagcactttctgttaaggaacttccggaggaagaacttaatgaaggagaagtaaagaatgataatgaaaagtatggaatggtacaggcattcaagcttcttgtcaaaaacaaatattacatgatgatttgtggaacatatattttacagcagttatatggtgccatgattggagctggcatttattacatgacatgggtactgaaaaataagaatttgtttggacaatttgcatgggcagtaaatattccactgatcattgccctgattttcacaccgacattagttggtaagtggaaaggtatgtataaactgaacttaagaggttacgtcttagcagtcatcggtagagcacttgttgttgttgccggatatatgggcagtgttccgctgatgatggcatttacagctcttgcagccttaggtcagggaccatggcagggagatatgaatgcagttatcgcatcttgctctgaatacacttatcttacgcagggaaagagaattgacggaacgatgtactcttgtacttctcttggtgtaaaaatcggtgggggtattggaaccgctgttgttggatggatgcttgagttcagtggatatgtcggaacaaatgtaactcagccacagtctgcacttgatatgatgcagttcatgtatctttggcttccgttaatctttgatgtattgattatgtttgtactttcaagaatgaatgtagaagatgcaaataaaaaactgagagcagaaaaaggaattgctgcagatgaagtaacagatgcattagacataaattagaattgacaggagaaagcgttgtctggtcgttgctcgatgagacagtgcttttttctatatataaagtgatagaactgtattttgaaaataaaaaaggaccacttcatttttgtgaaatggccttaagaaaatattcagttttcacaaaatagcccttttagtatttatacatggtaaggatgctcaaaatattcagtgtagaatactaaaaggtcattcagatgtttttttaggttgctcatttgcaattcctcctttccttatttacaagttgattataagataggtgtaaaaggattgcttgccaaatcgaaagaagatatagacaaatgttgcaaaggggagtatttcatgcagttaaaatatgttgacacaaaagaggagattatagcaataaataggaagtcaaaacatattgaaccacatcttcataatgcactggagatcgtttgtgtaacaagtggatcattagaacttggtgtcggacaggaactataccatatggaaaaaggagatataggctttgtatttccagatgttattcatcactatcaggtactgacacccggtgtaaataaagcgacttatctgattgcatcgccatttacgatagccaaatttgcagatatcatgcaatccatggctcctgaatacccaatcatcaaagcggaaaaggttgaaccggaggtatatagggttataaatgcaattttagagacagaacggtcggatattactgttgcacaggcatatcttcaaattgtgttggcacgctgcataggaaaattaaatttggtagaaaagagcagtgtggggagcaacgatcttatttaccagacagtttcctatatatcagcaaatttcaagaagaagttttcgttggaagagatggcaaaagacctgggcgtgagcaaatatgttttatccagactcttttccaagacattccatagaaactttaataaatatcttaacgatgcaaggctgaactatgcatgccatcgtttggaaaatacgagtgattctattacaaatatttgtctggatagtggatttgaaagtcagagaacgtttaaccgagtatttaaagaaagatataaaatatcaccaagtgattatcgaagtacttgtgtgaaagagatgttgtcataaaaggttctgttaatcgaaatatttactttgattttacagtgctatgtatttgatttcatgtgtggatgatataatataaaaatatttgtaggttgaagagagttattatgaaattaatgggaaacgtcatgcatctccacatcttttccttatcacggaaatagaacaggaaattttgctttcttcttatgaaattccaaaaggagaagataaaaatacattttcataaataaaatccttttgtttgccataggctcctcccactacctttaggtggtgggaggagccttgtaaatctttagtcgctaaccctgattctcaatatatttttgtatagtggctgaagatacttctccaatgctacaagcaaaatatccgtctgaccaaaatatcttcttcttccaatactgtttagatagaagcgaaccatatttgtgccataaataatacgttgtttcttgctttacaattttgacaatatcgcaaactttatctgttgtatcgtaacttaataagaaatgtatatgatctttgtcggtttctatagcaataatttcgtagccataagcattagcaatatcgaaaatcttttgtttaacatcatcagcgatagaatctttgagtaattgtttacgatatttggttactagaactatatgtactttaaggttgtatttccgtctgttatgacgattgtatctattatccataattcacctcaaaacattgattttcaccaattgttattatataatatatttagtgaaatatctacgaaaggagtacatctatggaacagataactattacagctaaaattcaaatagtcgcaacggaaacggataaagttttgcttgatgaaacgatgtctgtttatcgtaatgcctgcaattatgtttcagactatgtattccatactcacgacttaaagcagttttcacttaataaggttttgtattctactttacgggaaaagtttggtcttaaatcgcaaatggctcagtctgttttgaagaccgttatcgccagatataagaccattctagagaatcaaaatgaatggattaaaccctcgttcaaaaagcctcagtatgatctggtctggaacagagattattccttaacacaaaaccgcttttcaatcaatacgctgaatggtcgtgtgaagttatcttattttgcagatggaatgtctaagtatttcgaccatacgatctataagtttggtacagctaagcttgtaaataagcatggtaagtattatcttcacataccagtaacctatgatgtcgaagaaagtaatatttctgacatctgtaatgttgtgggcatagatagaggtattaactttgttgttgccacttatgacagcaaacacaagtctggatttgttagcggtaaggctataaagcaaaaacgtgctaattattccaaacttcgtaaagaactccaaatgcgacggacagcatcttcaagacgaaggataaaagctattggtgggcgagaaaaccgttggatgcgggatattaaccatcaggtgtcaaaggcactcgttaaaaataacccaaagcacactctctttgtattggaagatctgtcaggtattcgtaatgctgcagaacgtgttaaaacaaaagaccgttatgtttctgtatcatggtctttctatgaccttgaacaaaaactaatctacaaagcaaaacagaatcagtcttctgttattaaggtagaccctcgctatacaagtcagtgctgcccttgttgtgggcacgttgaaaagtctaaccgcaataagaagatacacctgtttacttgtaaaaactgtggttacaaatctaatgatgaccgcattggagctatgaatctgtatcgtatgggaatagactatcttgcagatagccaagtacctaatacagttgtaacagagtaaactctgctacaaagggtgctgtcaaccaccctatgatgtaacgccactttagatagcaatatctatcggggattaaaggtcggaggtgtaagccgttagtacgactgggcagttacaagcccatgacctttaggtcgtgggtagttgacagaatggttgatatgaaatcatgtaatgatactccttttaaaatagagtatcaccaacaatagattgagtatgctaaatgaattgagtataaataaaacataaaaattattctgtaaagtgaagatatgtgatataatacctaagctgccgaacctccagcagaaaggaggtgaattcctatgggagaagtatttaccagttttcttatctctgtcatagcaggagtagttagctactacatatgcaaatggctggatagggataaataggcagccacagcctaaacggagtagttcaccgtaacgaacaagaaaaccctcagagttgccgctctgagggttttcgttttgcctatgggaatttaccagtttccttagctacgttcattatatgccagagcaggaaaaaaatcaactaagaaaaagaaagatattactttttttgttgtcatacagagggaagatgaggaagaatataatcaagagtataaaaataagcgaccgagtgtcgatgcacttgaaattaaaggaggaaaatcatgaaaaaaagtaaatttttattgcaatgccaagtataaagataagtaatgagaggggcaatttttttgttgtgattatcaaaagataaagttgttttttcttcggttctatcaatatccatatcaaattattcttcaaacaaaaagagtgtatgcatgacatcttcataggtttggatattaatgtcagagagtgcggataaatctgcatcaagagcatcagctagcttatttcgtatctctgttttgggagccattatatttttttcatattttcttattcttgagtcggcagttttagaagaaaagccaactttttcacccaactctttttgagcgagttggcgtaataagggccaaagcctatgaggtgataaagcaactgaataaggaaatgaaagaacagaatccaagagcaattgtagtatgatgatgccggaagatgatgaaattctcaagaatggtacagtagattttgtttacatcagttattattccagcaactgcgtcagtgtcacccaaaaaggggaaattactgcggcaaatggaggagaaaatattaagaatccatatcttgaaacttctgcatggggatggcagattgatgttttactggtacaaaaaagtcattgaatcctgcggagaaaaattataaaaagattcagacagaaagcccttttggagaataatatttcttcaaaaggatttttgatatatatggataattcctgatgaaaatctatgttaaaccatgtataataggatttgtggataataaaaaataaaaatggatgaggaatgaaaatggagggaaatttaacaaaaggtcctattctaaaaacgctgacgaaacttgcggttccgatcatggcatcatcgtttctgggaactttgtataacatcacggacatggcctggattggtctgcttggttcaagggcagttgcaggtgtaggtgttggaggtatgtttacctggctttcgcagggacttgcagctatggctagaatgggtggacaggtgcatgtggcacagtgtatcggacgtggagacagagaaagggcacacggatttgcacaggcggcagtacagcttgctgcatttatgggaatggcatatgcaattctttcgctgctttttaccagacagatggtaggattttttcagcttgcagatgcacaggctcatgcggcggcaatgtcatatatgaggattgcctgtgggctgatcgtattttcttttatgacgctgacactgaccggactttatacggcacagggagattcaaagacaccttttatagcgaatcttgtcggtctggccacaaatatggttctggatcctgtgctgattcttggagtggggatgtttccgaagcttggtgttgtcggggctgcaattgcgacagtgacagcacaggcgatcgttatgagtatcatgatagtcggaattgtcatacaaaagaaagaaaatgtactaaaaggaaccaggcttttggcaaaaatcccgcgggaatatctgcagggaatctgtaagatcggaattccgacagcaatacagggaatggcatattgtgcaatctccatggtgctgacacgtatgatctccgggtatggtgcagaagctgttgcaacgcagagagtcggagggcagattgaatcgatatcatggaatactgcagacggttttgcagcggcattaaatgcctttatcgcacagaactatggtgcgggcaaaaatgaccgtgtcaaaaaaggatataaggcttctttgtggacggttggtatctggggactgttgatctcagctgtatttatatgtattccggaaccgattgccagaatcttttttcatgaacccaaagcaatcgcaacatcagttgaatatctgatcatcataggtttcagtgaagcttttatgtgtgtggaactgacgacagtaggtgcattatcagggctcggcagaacccgactctgcagtatcatcagtatagcttttaccagtgcaagaattccgctgtcgatcattcttggaggtattatgggtctggatggaatatggtgggctatttcttcaacctcaattgtaaagggaattatttttacctgtacatttttatggctcacaagaaaacgacggtaaactttcaaaaacaatgtgtgtaatacagaacagcagaaggaaaggatggcggaaccggataccgttatacctgtcaggtgggcgggaaaatctgtcatctgacttatgaagaaaaggaccggagaagtgagactgccatcagatcataagatgaaaaaataaaaggtattgatctataaagaggggatccgaatcgtcaaatttgcttgagatgtcgggttctctttttgtttgcataatgatatacttttattgtgattaaaaaagcacgtacaaaactcataggagaaagatgtatacttatgacaatattttctgaaatcaaagggaaaagataatggcacttatatccgtgtagcaggtacatcaagacaggcatttccggagcagataaaagaactggaaatggaagaagccagaatctcataggatgaacttacctgtgtgggttatcccgtttcagaagaagctacagaaaaactttgccaggatatggaaaaaattcggaaaaaagctagaatggcagaacattctgtgaagaaagagcagctgataaactggaagatcttaaagcagagtgagggacagcttctggcaacgaatgcctatgcgttgctgacatcagattatttttcattctccaaaacacaatgtgcggtattcaagggaacagatcgagcagtgtttctagataagagagaatttacaggaccaatctacacacaaatcgaagaagctgtagactttgtattgagaaatattcgactcggagcaacgattgatggattggtgcgaaaagagaaatatgagctaccaccggaagcaatcagggaaatgatcattaatgcccattgtaatcgtaatctgttggatgaatcttgtattcaagtcgcagtttacgatgacagactggaggtgacatctccgggtggcttatataacggattaacttatgagaaagtcatgaatggtcattctaagattcggaataaaggcattgccaatatattcagtcagatgggactagtagaagcatggggaagtggaattaaaagaatccttaatgctgcagaagagtatggacttccgaagccgagatttcaggaatttgataatatgtttcgggtagagctgtttcgagttaatccaataactgaccaagctaaccaagctactaaccaagttaaccaagattttgagagattagattttttctcttgtttatattccagattcacctgcaaatttcgtgaaatcagttattctcataaaataaaattagagtaaatatgaagaacagtttgttttgattgaagtgattttcgtcaaggcagactgtttttttgttgcctgcatttagaaaacagataccacagaaaggttcttaatatttcctataataaggaacattatatgtttgatcagcagcatcagagaaataatacagtattattttgtagattagaatcagaaaacggctgtgcgacagactttatcgcagatagcggacgtgacattgcatcggatcacaaaatgaaaaaataaattcctaaaaaattaatcatgataataatgtgatgatatcacagaaaacaaatgaatttcagattataataaagccataaaaaaacaaggaggactgtaaaatgtctgctattaatatcaataaaaataattttcagaatgaaataatggattccgagaaaaccgttcttttagacttttgggcgtcttggtgtgctccttgccgtatggtggttcctatcatagaggagattgcaggtgaacgccctgatatcaaagttggaaagatcaatgtggatgagcagcctgaactggcaagtaaatttggtattatgagtatcccaactttggtggttatgaagaataggaagattgtacaacaggtttcaggtgcgagacctaagaatgcaattttagaaatgctttaaggaggtgcgctaatgagcttttttgatttctttaaacaggcgaatattaattgggatgttgcaacgaatgggatattctaaagtaaataatattggtggcattgctgcttattcaggaaaggtggaaaaataagatgaaggtaataatcgtaggcggtgtagccggaggagctacagctgcagcaaggatacgcagactggatgaatatgcagaaattactgtatttgaaaaatctggatacatatcctatgcgaattgtgggcttccatattatattggagacgtgatcacagatccggaagaacttacattacagacaccagagagtttttttaaacgtttccatatcaatatgaaaattcatcatgaagttatctccatatatccggatcgtaaaactgtttcagtgaaaaatttggagaatggtgagatatttgaagaaaactatgataagctgattctttctccaggtgcaaagccaacacagccgagacttcctggagtaggtattgataaactttttacacttcgtactgtggaagatacttttcggataaagaaatatataaataagaatcatccaaaatcggttgtattggcaggtggtggctttattggtctggaactggcagaaaatttgagggagcttggcatggatgttacaattgtccagcggcctaagcagctgatgaatccttttgatccggatatggcatccatgatccataatgaaatgagaaagcatggaataaaactggtattaggctatacagtagaaggatttaaagaaaaagacaatgaggtggaggttttattgaaagatactccatcccttcatgctgatatggtagtactggcaatcggcgttacaccagatacagcattagcaaaagaagctggtctggaacttggcatcaaggaaagtattatagtgaatgacagaatggaaacttctgtaccagacatttatgctgcaggtgatgcagttcaggtaaaacattatgttactagcaatgatacgttaatctctttagcgggacctgctaataaacagggaaggattattgctgataatatttgtggtggtgatagccattatttaggcagtcagggaagctccgttatcaaagtatttgatatgacagcagctactacaggtatcaatgaaaccaatgccaaaaagtcagggttagatgtagatacagtaattctttctcctatgagtcatgccggctactatcctggtggaaaagtgatgaccatgaaggtggtttttgaaaaagagacttatcgtttgcttggtgctcagattattggatatgaaggcgttgataaacgtatcgatgtgctggcaacagcaattcatgcaggactgaaggcaacccagttgaaagatatggatctcgcatatgcaccgccatattcctctgcaaaggatcctgtaaatatggccggattcatgatagacaatatggcaaaaggaatcttaaaacaatggcatttggaagatatggataagatttctaaagataaaaatgctgtgttgttggatgtgagaacagtaggtgaatttagcaggggccatattaatggatttaaaaacattcctgtagatgaactgagggaacgtatcaatgaagttgagaaaggaaagcctgtgtatctgatatgccaaagtggtctgcgcagttacattgccagccgtattctggaaggaaacggttatgaaacatacaacttctccggcggattccgattctatgatgcagtggttaatgatcgtgcgctgattgaaagggcatatgcatgtggtatggattattaaaaataatcacaatatttttataattttcttgtagcataaaaaaatcccccatttattaggatgacttttataattctgataaatggaggattctttagatgttatcgaaaacaggtttatgatctttgtagtgtttccagttttttcaaatcaaggatggtgattttgccgcgtgagagtttgacgaggccttcgccttgaaagtatcggagcattcgggtgataacttcccggtgggaaccaagatgattagcaatcgtctcatgagtgattttcagttcgtttgtttcttcgatagaggtctcttctaaaagaaatgaagcaactcgcttatccaaactcttccacatgatttgttcaatcagccacatgacatcagaaaaacgggtagccattaactcattggtatagtttgcgacgggagcagattccttcatgaggaccttatagatttcagaagggatgatccaaagatcagtatctttttctgcttcaatggttacttcaaattgaatggagcgtatgatacatgaggcggataaaagacagatatccatgtcgaacagacggtagagtgtaatctcccgtccttcatctgaaagtatataagttcgaagctgcccggttttaaccagtaataatccggtacagtccaagtttccgttgtgaatgaccgctcctttttttacatgctgtgtgattaaattatctgaaattagttttttctgtgctgtatttaattcgttccatactggaaaataattatcaaagttcataacagttatctcctttacgaacatagtatacttgcttttttaagatgcgtcaattacataattgacatatgccataaataaaaatatactgattatagtacatgactgttgtaaatatgagggagggataaataatgcagggagatgtcagttttacatttttggaccgaattgaaaaagtagagctgaatattgtagatagacgatggcagtctgcactggcattggcattgactttgccggatatttgcggagaacgctgttggcagcttcggtgtgaatatcttcatcaaaacaaaggatttttaaatgatgaaaataatatacactttcatcttggattgaactgtggaatgtcagtttgtcagttggacagtatgaacatacaggagaacagaatcgatattcgtatagacatagaacagttttgtctgagaatgtgcaaggcagcaaagagttactatgataaagttaatttggaaaaagactttagtctctataacacaccagttttggattttattcaggtaacacaaaaaaagaaagatgcttctattattgcactgatttgtggcaatgaacgctatgcaaaaggattaaaagaagcattgcagtttatttcagagcagattatgctgttttacacaccggaaagcgctaaaacaaaattaggaaaacataagccggatctttggattgttaccgaagatatgacgagacaaccgaatcagccatggcgtgctgacaggacaacacctgtaattataatcacaggcaatcctgatgctgttgaaattaaaaagaattcaggaaaactaactgttctttctatgccattatcaatagttgatttgcggaaaaacgtcgaaatatatgtgtcgtgaggagaagtttatgctgtacataatactattatttgcattcatagttatatatttgatgatgcttatgcggagacagaaagataagatgagcgaaattaaaatacaaatggatcaactgcaggcacaacatgatgaattgcagaaagaaagggatcagttactagaacagatgaatcatctggaagagcaacgagaacacttgcaaatgcaaacagaccaagcatttcggagtgctgatgaaattgagaaaatttgcgatgagatatggcatcatgctaataccatccacctttattcttcgttatctgaagaagaaagcaaatctataacaatgaaagaaaaacaaaaagtaattattagaacaatcgaggagattataaacatcatatataaatataaaggtgatgtataataaaaatatgtcattctagttattagcgttcaaggtaaattcttatgtaataatatcacagaagaatttacctttttcaggtacaatagagataccaaatttgaaaggagaacaaagcattggcaaaaagagtggcaagtgtcgataaaaaaagctgtgctgcctgcggagtatgtgaaaatacttgtccgctggcagcggttaaagttcatcgtggatgctatgcggtagtagaagaaacattgtgtgtaggatgtgggaaatgtgcaaggtcctgtccagtaggctgtattgaaatgaaagagagggtagcagtgtgaagaaaaagaaactttggtatgattatttatggatatgggcgatcatttattttgctctcagtttttttaatattttgttcgcttggtttgggatgcttgatttcctgttgccgttaggaatagcaatattcggtggaaataaatttttctgtaatcatttgtgtggacgtggccagctttttagtaagcttggtggagattttaaatgctcaagaaataaaccaaccccgcgatggatgagttcaaaatggttccgatatggctttttgatatttttccttacaatgtttgggaatatggtatttcagacatatttagttggtggcggagcatcatccctgcatgaagccatcaaactattctggaccttccgtgttccatggggaaggacatacatgtggcgagcatggatgtggaagccatagctgtcattaagaagaatagcaaaaaataataatacgaaggatgtgccaaggtaatggagaagttaccgcagcgcatcctttttgtgttattttcatattgattatttcttacttgccgaaagtaatgaatggaatgtataataattattaagcatccaaagagttttattttgaaaataaaattattgttgtaaaaaatgcagaagatattacatggcttgcagatccattggcagaactgaaagcaagattacttcagattcgaaagatttggggtgttgagattgttgtattaaatgaagaacttgcaggcgaatataaattgacttgctaatcactattttggtgtactactaccgaagtcgttgaagtgtggaactataatataaaaaatatattgacatatagaagatttggatatgaaagcagtgtcgcggtcgctaaattttgggaaatctgtttcagataatggatggggaatgttcacaacatttttgaaatataaactggaggaacaaggtaagaaacttgtgaatgtggatagattttttgcaagcagccagacctgttctgtttatggttacaaaaatgcaaaaacgaaaaatcttgcgttaagagagtgggattgtccacagtgcaaaacccatcatgatagagatgtaaatgcggcggtaaatatcagaaatgagggaatgcggctggtaaatgcattaccttaacacaatataacacaaccgtgggacacacggggatagctcgcttatgcttagcacagtagtgttatcgaacgagaaccaaacttgccgaggttgggaaggcccacctttacaggtgggggaggatgtcacagggaatctctgtagaggagttatttagagtaagagaggatattaagactatgagtattaccaaaatagtaataacaggcggtccatgtgccggaaaaacgacagggatgagttggattcaaaatgcttttacagaacgaggttacagggttctcttcatatcggaaacagcgacagagttgatttccggaggagttgcaccgtggatctgttccgataatacggaataccagaaatgtcagatgaaacttcagttggagaaagaaaaagtatttgaacaggcagctagaacaatgaactcagataaaatattgattgtatgtgacagaggtactttagataataaggcatacatgacagaggcggatttttccctcgtattgaatgaacttggcttaaacgaagttgaattgagggatggatatgatgctgtattccatcttgttactgcggcaaaaggtgcagagaaattttatacaactgcaaataatactgctagaacagaaactgtggatgaagcggttgcattagatgataagttgatagcagcatggacaggacatccacaccttagaatcattgataattcgttaggatttgaagaaaagatgaaacatctgattgctgaaattgcaaactttttggggaacctgaccatatgagatagaaagaaaattcctcatcgatgcactgagaaaaaataaaaaatcataggagtatagggacaatgatgagaaagaatactatgtttcgcaaatatataccatcgcttctgttatttttgttatttgagctagtggcgattacgttgtggattgctaagtataacatattttatctgttgaatttcagctacataggaggatgccttgcattaggaacagcactttttactgccggaaaatgctatgccagacattttgtgcaattggcggtaggaagttatatgttattgtatcttggtataatctcctgtgaaaatatgcagattgagggtttttggtattatttgttcctgggcgtttttgaggcagcaacaatccactatgcagtagcaaagatttttggccctttgctttttggtcgaggatggtgtggctatgcctgttggacggctatggtactggattttctgccttataagcagccgaaaaagccgcgaaaggaaaagttaggtgttctgcggtatgtgatgtttgtattatccctggcagtggttctcagcctgtttttgatgaaaatcgcgaatctggagagaatcatgttctggatcttccttgtaggaaatacattttactatattgtaggtattgtgttggcttttgtatttaaagataaccgcgcattctgcaaatatctgtgcccggttactgtgtttctcaagccaatgagctacttttcgcttttgcgtgtccattgcgatgaaaataaatgcatccattgcggcaaatgcctgaaagtttgccccatgaatgttgaagtcaataaagaatcccgtaagcgaaaaaatgggacagagtgcattttatgttatgaatgcacgaaagtctgtccaaccaaagcactgcattagagcgtatttgaatcgagagaataatgtccatcataaattagctatacttgaggaacagatacatattgaaagggaaggtactatagaatatgtacataaagaaaaatagtatatatgtgaaaaatataaaaaattcctagtaaatatgaataaatcacagaactttttgagttggtgagcggatgatataataagcgcaacaacaaaactcaaaacgaaagcagaggcgtataaattatgattacattgtttgtaataggaatactgatattatcaattaaattcattgttttagcatgtaaagctacatggggaatggcaaaagcattattatttattataggtctgccagtgattttaattggattgctgatagcaggattcatatcattggcagcccctcttttaattataacactgatagcagtatttatctggagttttgcgaaacaatattaaagcgctcttaacttctccgcataagccagaattctcttttcaaaatcactgttattctgcatttcttctacaagagagtagacttcttctgaatcagagcgggtgatagtgataaaatctgtttccatctcatcagactgcccgtaaagaaagtcaagattacaatggaaagtgtatgcaatataaaaagcgtactgataagaaggttcgcgttcccctcgttcgtagcggccataagccatcgcagagaggtttaagcgtcgtgcagcttcagctttgttgatatgtaatgattctctcacttgaattaatcgttcgggacaaaaatgcatatgaattctccttaaatattgataaaagttataagtttattaaatataaatattacctttattataaaggataatgattcatatagcaagaggaggttctgatttgccgtgagcggaggaggcgaactcaggaaggtaaataaagaatcattgacgcaactttcattttggtatacactaatttctatagcaattctataaaatacagtaaggaagccagatcgtgtttgaacaatcaaaaggcaatctgcatgccataatttgcagaaagtattttcaaacatgctctggatttgttttatagattgttacagatttgtatatctgaagatatagattttcacgaaatagttgttaaagtaagcaacttgtagttctggtttgtatatctaaagatatagatttttacaacaagaaaagtgaggagagtacaaagagatgaaaggtttttatcaatggtacagaaagcacatcaccggagcgatttttgccggactgattctcggaattctgacaggattatttctggcagataagtttgaagttgtgcttactgcgacaagtgcattaggaagcatttatatgaatgcactgaacatgatgattttcccattagtattttgttctatcgtgatgggaattgccagtattggaagtgcaaaaacaacaggtaagattacaggagcggctatgctgttttttctgtgtacaacagcacttgcaagttttatgggattaattatcccaagactcattcatcttggacgaggcgtaaagtttgagatggcaacatcagatattcaggcaacaaagatggacagtattttagatacggttaagagtctgattccatctaatccagtgaaggcatttgcagagggaaatatgctgcaggtacttgtattttcattggttatcggatttacattaattgcaatcggtgaaaagggagagccattattaaaagtaatcgattctctcaatgaagtgtgtcttaagattatcagcacagtaatgtatttcactccaattggagtattttgtacgattgtaccggtagtagaggcaaatggaacaagcacaattgtatctttagcaacacagcttgtcattttatatattgcattctttggatttgcattagtagtatatggagcggcagtaaaagtacttggaaagacaagtccaattcgttttttcagagcgattatgcctgccgcattaaatgcgtttggaacctgttccagttctgcaacaattccattaagcaaacagtgtgtggaagatgaacttggcgtatccaatcaggtttccagtatcaccattccacttggcgcaacggtaaatatggacgcagtatcaatcttaatgtcatttatgatcatgttctttgccaatgcatgtaatgtaaatatcagcatttccatgatggtacttgtactcttagcaaatgtactcctatctgtaggaacgccgggaatcccaggtggagcgattgcatcctttgcggcccttgcgacaatggcaggacttccagcaggagtcatgggcgtgtatatcagtatcaatacgttatgtgatatgggagcaacttgtgtcaatgtaattggagacatggcaggatgtgtcgtattgcaggaacaaattgatatagaagcataacttttagtttgccgctggcaagagagccccacccaaaaaaaagagagaatctaccccatatatgttagtcgcagcggtttgaatgctcacttttgcgctcgcatccaaaccttgctccgaggtcacatatatggggtattcttgaaggtaaagaattttaagcttattgcttaccttttttgaacattagcatcatttcatttgtcagactgaaatcatcaggctgtaatacgatatcttctcgtttcttccattctgcgagtttcaattcagattcatccatctggatttcagtatcgccatcaacatcgcaataaaatccagcaagaatatcatcaacaattccccagggctgagatttataataacgaatattttttacatgaagtccagtctcttccataacttctctttgaacagtttcctctaaagtttctccaatctccgtaaaaccagcaaccagtgcatagtgagcaaagccggtacgatatttcgttacaaggatttcatctccattgcaaacgcccacaataactgcgggtacaattcttggataaataacatgtccgcaagaaggacactttaaggcgcgttctgtagtggaatgaactgttttgcttccgcaccggccacaaaaacgattattcttataccaattactaagctgaaatcctgtaattccagtaaaaatacgatatttaggatgcacttccttcgttcggagttttctgacaggagcaaaatcatatccttctggtaaataagcaggttctttttccagtaaaaagtaatgggcatcatcaacagaaaaaagataagtaagatcatctttttcaaaagggaactcatcaatgtcagtagtatcactgggaaaatcacgaacagcagggaaaaagagatagttatcatactccttatattgaccgagccggtgaagaactccttcctccgtaaaatacaaaacgatactgtccatatctggtacggcatttatatcataatgattatctaatttatgtgggtaaatatcttgaatcataatctaaaacctcctgcaaatataataacacagattattatttaattcattagacaaactacagacgaagccattgctggagaagatgaattaaacagggggaggggatttggggacagaagctgatgtattctgcttactcgagaaggactgggaatagagggtatgatttgacctgcaatattctgagagcaagcagaaaacttctgccctctcccccaaatccccgcaaccactatttaattcaaacaaaatccagccaaagacagcccgggaagagaaccgatagcctatatttgtggcctcggagctacgagactgtagtaaaatgttagaaaaggccgacatgaaaaattattgattttgacgactttgtgttttgtacaactgagtcaaaatcaataacttttcatgtcggccttttcatagaagacggtttctcgtagcgactaaagtcacaaatataggctatcggttctcttcccgggcgtctgtctcttaatgaattaaatagtaatttcccacatcttgtgatacaattatatgataatgtctaaatttaaggatttatttctgatagtagagggtggacatttttcagatagagaaataaagatagagaacaaaaagaaagttagaggaaaggatatgacaaagttttttgtgaagaagccatattttgtattggtgaccgtaatcattgtcctggttattggttttgtcagtctcggtgagatgcagacagatcttttgccgaaaatggaactcccatacatggctgtgattacaacggaagtgggtgcttctccggaaaaggtggaaagtgatgttgttaaaccgatggagagtacgattggtacgattaacggcgtggagaagctgacaagtacttcggcaaataattatggaatgttaatgttagagtttgcagaagatacaaatatggaggcagctttggttcgtgtatcgaaagcgctgaattcattagatttgccggagggctgcggaacacccaatattatggaaatcagtgcggatatgatggcaacgatgtatgccagtgtcagttatgagggaaaagacattaaggaactgtccagttttacggagcagacggtaaagccgtacctggagcgtcaggatggtgttgccagtgtatctgcgaatggcttgatacaagatcatgtggagatccgactgaatgagaagaaaattgaccggatgaatgataagattctcggacagacgaatgataagctccttgaggcgagtgataagattgaggaggcgaaggcttctttaaaaaagagtaaggaacagttaaagaagcaggaaaagacgctgagcagcaagcaggaagagacgaatacaaagcttgcagaggcacagacaaagctcgcagaagcgttatcccagaaagcagcatatgaggcggaacttaacagcttaaaagcgagtcagagtgcattaaaagcggagaagaaagcatataaagatgcaggtttagagaagacgtataagacgctgaataacacattcaaaagtttgaatgcgacaatgggagaggctgcaaagcagatgggaattacgattccgtcttctgtaaaagaagcaatacaacatccaaagcagtttgaagcctttgtttcctggatggagcagatggggtatggtgaacagttttccaagctgacaatagattcattaaaacagatgtataaggcagtggaggttcgcctgccacagattgatactgaactttctaacctgcaagtaaaaattaaggtacagaaagcgattattgataaattaaatgaacagatgaaaggcttagatgagcagcagtcaaagcttattgcaggcggatattcagccgctgcaggatttggttctggacaggcacagattgcggcaggtaagacacagatagaatctgcggaaaaagagttaaaggattcagaagataaactggaagattcccgaaaggcggcaagagagaatgcaaatattgatacccttttaagtctcgatacgctgtctgcgatgatttcagcacagaacttttccatgccggcaggttatattgaggataagagttcacaccagtggcttgtggaagtcggagataattttaccaatgaaaagcagcttaaaaaccttgttctcacaaagattgacggagtgggaaagattcgggtaaaagatattgctgatatcacagtagtggataatcagggagatgcttattctaaggttaatggagaaaatgcgattcttttatcagtatttaaaggaagtactgcaaatacgagtaccgtatccaagggaattcagaactcttttaaagatttagagaaaaaatataaaggactttcctttaccacgataatgaatcagggtgattacattaacattattataaagagtgtattgagcagtatccttttaggagcagtacttgcaattattgtacttgctcttttcttaaaagatatccgcccgacaatcgttgttgcattcagtattccgtttagtgtattatttgccattattatcatgtattttacgggaattaatattaacgttatgtcgttggctgggctttgtcttggtatcggtatgctcgtagataactccattgtagtaatggaaaatatttaccgttttcgaaatgaaggaatgtcggcatcaaaggcagcggtgcggggaacagcgcaggtagcagggccgattcttgcatccacgatcacaacaatctgcgtattcctgccgatggtatatacttcgggtatggtaagccagcttttaatgccgtttgcatttaccatttcctatgcattaattgcttctttattagtggcacttactgttgtgccgacaatgggttctgtgcttcttagaaaaacaaaagatgtaaaacagccgtggtttgataagataaaagatgtgtatggaaaagtgttagaactggctctccgatttaagattattccgttagcgatttctattgtacttcttgtactttgtgtgatgcagagtatgcggacgggaattgttatgatggatgacatggacagtaatcagattgcagtcagtatgacattagatgataacgtaaaaaaagaaaatgcttacaagacagcagatgaggttatgggaattctaactggagtagacggcattaaaaaggtttccgcccttgatgggaatgccagtgtaacttccagtatgctcggaacaggaacgacagataattacacaagcttcagctttaatatcatcacagaagataatataaagacaacaaaggaatttcgcaaaatccgaaaagaaatcgagagcaaaactaaaagagtaaaatgtaaggaaatcacggtttcttcttctgcaatgggcgatatgtcaagtctttccggtggtgggctttctgtcaacgtatatggagaggaccagcagaagttaattaaaatcagtgaagatgttatcaagatgatgaaagagatttccgaagtaaaaacagcgtcaaatggtattgagtccgctgacaaaatgcttcatttgaaaattgaccgcaataaagcggcagaacatggactgactatcgcacagatttatcaggaaatattgaaacatactacaacggagaaaaatgcgattacgctcaacatggatgagaaagatgtggaagtcaacctcattaatgagacggacaaactcacctatgaaaatattttagatatgaaaatagaaacaaccgagaaaaacagtgatggtgaggatgaaaaacatacatataaactgtctgattttgcttctgaagatgatggatacagcatggacaacatcaccagagaaaaccagaaaccatatcttaccgtaacggcagaaattgatgaaaatgcaaacgcaacccttttatcaagaaagttacaggataagattgataaatacaaagcgccaggcggctatgaagtagaactttccggtgatgccacacagacaacagatatgttaaaacagatgggaaaagcattagcacttggattcatgctcatttatttagtaatggttgcacagttccagagccttttatccccatttatcgttatcttcactgtaccattagcgttcacaggaggaatgatcggacttggattttttggaatgtccatctccgcaatggcgttgatgggattcatgattttaatgggaaccgttgtaaacaatggtattgtgttcgttgattacgtcaaccagctgcgaataggtggcatgagtaaacgggaagccctgatagaaacaggaaaaacaagaatgcgccccattctcatgactgcactcaccacaattctctccatgagtgttatggtattttcacaggatgccggaaatgcgatgcagaagggaatggcagtggtagttgcatttggactgctctatgcaacattgatgaccctatttatcgttccagtcatgtatgatattctctaccgcaaacaacccaaagtgattgatgtggaggattctgatttgtagcgtgggctgtctttggctgtctatataaattcagaactcatattggagggatttgaggaaggctttagaggggtatggctttctggaaagttggttttaactattagtggaaatcataaatcaatgtgctattataacaatagtttaagtgtcaaccttatggtatttcatttcttgaatattctatatcgccaatctccttcctcaaatttctcaaaaataatttctgaatttcctttaactgtcaaagacgatccttcgacggatttgcaaattattccaaaatagattgcattttttcttgcccatccaaagcacagcccacagtaaataaaagaaactatatttgtggcctcggagcaaggtttggatactcgcgtgtataagcgagtatccaaaccgccgcgactaaagtcacaaatatagtttcttttattttctgtgggcgtctattactgtgcaaatcaaaatttagaaaaatttatcatataatccaaagaagaagataaacagtacaattagcggaaggatgtaagtaatatatcctcgcatccagttctgcatcttaagcccctttcccgtgttggcttctgtagtaaagttcttccatccccatccgtatcggcttgtacagaataaaagatatacaagggaaccgagtggaaggaagaggttacttactaagaagtcctcaaaatcaagtacagcaccgccaaatacagcaaatccatcccagctccataagttatatccaagtacgcatggaatagaaagtaagataatagcgatggcattgacaaagcttgatttctttctgctccatccagttaattccataccgcaggaaatgatattttcaaatacggcaagaatcgtggaaaatgcggcaaaggacataaatacgaagaataggcttccccataatcttcccataggaatatggttaaagatatttggcagagtgataaaaataagccctggtccggaagtctggtctacgttaaatgtaaagcaggcagggaagataatcagtccggaagtgattgctacgaatgtgtctaagagagcgatgtttaaagactctccaagtaaagagcgttcctttccgatataacttccgaagattgccatggcgccgataccaagacttaatgtaaagaatgcctggttcatggcaccggtaatcgttttaatgattccgatttctttcattcgtccaaagtcaggaattaagtaaaaacttaagccttcctttgcgccgtccataaaaaagctgttgacagcaaggacaatcataataaggagaagggaaatcatcattacttttgttactttttcaagtccattctgtaatccaatggaacatactaaaataccggcgataacgacaacaaccatccagaatcccataacgagcggctgactgagcatcgtgttaaactgttcggatactgtctcggaatcaagtccggtaaactttccagttgcggtcagatagaagtaatgaagcatccatccggaaacggttgtgtagaacatcattaacagataacatccgattaatgtgatgtaaccgtggatatgccatttctgtcctggtttctccaaagcgtagtaagcttttacaggacttttctgacttgctcttccaacggcaaattccattgtcataataggaagtccgagcatgagcaagaaaatgagatagaagagtacgaatgcaccgccgcctccttgcccagccatgtaagggaacttccatacatttccgattccaattgcacagccggcggaaatcagaatgaatccaagacgagaacctaatttttctctttctttcataaatacctccctgatgatgcactcacggagttttcctgtatttgattttgaaaatagctttttggtggctgaattcaaattttattaatgttatgcatcatatttattttataaatttgagtacaaccaatcaaaaaataacaaaattaaatatagaataattccgagattacaaaaaatgcttcaaaaattatatagtttaggcactaaaatgtcaagaattactttccttgattttatgggattctctgttataattataatcatgggataatgagaacaatttcagattcagaggatttttacatgtgattttatgaattgtttctgaaatagttatttgaatttttatatagtaaaatgtcaggaggagaatggtgtgggaaggaaatgtgtcggctttgtagaagccgtcggtcttgcagcagccttgcaggcagcggataccatagcaaaaagtgccaatatcaggcttttaggatatgagtatagtggatatgatggacatattcttattaagttcgaaggaaatgctggagcaatcaaggcagcggcagaagcagcagccgttgcaattcataaggtacatacggactttgaccagacaacggctgtgaatctggaaaagacaggactggatgaagcagtatatgatgttttagttcataacaagaatacagtaggagatccgttacagatagcctccggcaagcggccgcagggtacaaatcggcaggcaaagtgggttggccactgggagcagaaaggctgctatatccgagaatagtactatgcaatatgtttacataatggtataataaaaacagtaatatgtcataaaatataacacaaccgtgggacacacggggatagctcgcatatgcttagcacagtagtgctatcgaacgagaaccaaacttgccgaggttgggaagcctcacctatacaggcggggaggatgtcacaacagacaaaaaggaaagcgaggggaacggatgcaggcagatgaaacaatgacaaagcaggaatcagaagagatgataaagcaacttgaaaaagtattcgacattgtgcgtttgcttgatgaagaaactctctatggaggcagtggtattgagtcagagggcggcgaggtatgccagtgctattctttctggggaaggaatgaagtttgtgagaactgtatttcattaaaagtaatgcaggataaagtacagcgcacgaagcttgaattacttggacaggatttttatcaggtaatttcgaaatatgtaaagatagatggtaagccatatgcgatggaaatgatcagccgtcttgacagagaagttctggtagatgatgatggaaagaatcagttattgagtgagattagcggatataacgataagctttacagagatgcactgacaggcgtatataatcgcaggtattttgaagagaagattaagacaacacgtttttcagccggagttgccatgatagatctggacgattttaaaatttacaatgatacctatggccacgaagcaggagatatggtattagatactgttgtacagatcataaagaagaatatccgtaagagcgatatactcataagatatggtggtgatgagtttttacttttattgccggatatcaagggagatgcttttgagattaagctgcgccagattcaggaaagagttcatacagcagcagttccaggatattcacagcttcgtctttctgtgagtgttggaggtattttatcaaatggagagaagatagaagatgcaatccgacgtgcagacaagtatatgtaccaggcaaagatgacaaagaatagcgtagttacagaacaatctaagatctgtactgaagatagagaaactggaagaaaaggcgggcaaaagattcttattatcgatgattcggaaatgaaccgcatgcttctttcagaaatgcttggagaagaatttgatattttagaggcggagaatggaaaagagggacttgaaattcttcaacaatatggtacaagcatttccattgtactcttagatattgttatgccagtcgtggatggatttgaagttcttgacttcatgataaaggaacattggaatgaagaaattccggttatcatgatttccagtgaaaattcgccggataccatgcgaagagcatacgagatgggcgttgtcgattatatcagtcggccatttgatgcaagagtagtatatcgaagagtgctgaatactatcaagttctatgcaaaacagcgacatcttgttacgttaattacgaatcaggtatatgaaaaagaaaagaataatcggatgatgatcagtatattaagccagattgtggagttccgtaatggagaaagcggccagcatgtgcttaatatcaatattctcactggacttttattagaaagtcttgtacaaaagacagataaatatcatttgaatgggtcagacaggctgcttattataacggcatctgcacttcacgatattggaaaaattggcatcagcgatagaattttaaataaagcaggaaagctgacagaggaagaatttgaagtcataaaaagacatccgattattggcgcatctattttaaagaatctggcattacaccaggatgaaccaatagtaaaagttgcttatgagatttgccgctggcatcatgaacggtatgatggaggaggctatccggacggcttaaaaggagaacagattcctatttccgctcagattgtatcgttggcagatgtgtatgatgcattagtgagtgatcgcatctataagaaggcctattcgcataaagaagcggttagaatgatattagccggagaatgtggggcatttaatccacttcttttagaatgtctcgaagagattcaagggaaaataaaggaagaacttgaagttcaggatgttccagaaatttcaccagtaccagtacaatgtccgatttcagaaatatcagaattatccatgccagaagacaaaaagtaagaaatgttaagtaaaatgaagaagaattaaggagaacgacaatgacagtaaaagaatgttatgaacagatggggtctgattacgagagtgttttaggaagaatgggcagcgaagccatgattaaacgttttgccttaaagttcttacaagatccaagctttaataatttaaaagaaaatctggaaaaaaatgatggcgaagaagcgttccgcgcagcacatacattaaaaggtgtatgcttaaacctcggatttgatgaactctacgaagcaagcgcagaaatcactgaaaagttaagaggaaaagaaacagccggaagtgaagatatgttccagaaagtagaagaaaaataccagaagacagtcaacgcaatcaaaggtttagagtaacttctgctttgccgcaggcaaagggagacaccctcagagaataatccttatttgtgactttagtcgcagcgtgttgaatactcgctctgcccgcccgtatccaacacttgttccgaggccacaataaggattattttattctctgaggctgtctttggcagttgaagaacagtcagaattttatttattttgtgatacaatgcttcaaaataaacactttaaatgaaaaagcaggattatgatgagtttgttatggatattttgaagaaataaaattacaaggagagtttagatgaatacaaataatattcagaaagtaaattatcaaaagatattggataaaatcacagataaaattgagaaggagtgtgctgagggagaaaatcgcccagctcttttccttcatgcatgctgcgcgccttgcagcagctatgttcttgaatatctgacaaagtattttaaaattacgattttttattataatcccaatatcacaccagaaatagaatataccaaaagggtaaaagagcttcagcgttttattcatgaagcaggttatgaggaagatgttactttcgtagaaggtgattatgacccacaggtattttttgatatggcaaggggaatggaagacttgccggaaagaggacttcgctgttatcactgctacgcacttcgtatggaagaagccgcgaagaaagctgcagagatgggagcggattatttttcgacaaccctttcaatcagcccgcacaaaaatgcccagtggattaatgagattggagaaaaacttgctgataaatatggggtgaaacatctgccatctgattttaagaaaaaaggagggtatttacgttctattgcattgtctgaggaataccatctgtatcggcaggattattgcggatgtgtgttttcgaggagggattcggaggtgccgaaacagacgaactcagtaataaaaatagcacctacccccacgaggatgctcaataacatatagagaaaagccactttcggatgtccgcttttcatcagagttgcagattctaaagcaaaggttgaaaaggtagtaaatcccccacaaattccagtctttaagaaaagtacgagctttggattcggaattgatccttttgaggcgagcatggcaacaaaagcgatagcaatacagcccgctgagaatgaaataatccttatttgtggccttgaagcaagtgctggatacgagcgagtattcaacacgctgcgactaaagtcacaaataaggattattttcattctcagcgggcgtctatttgcctgcggcaaatcagagtttaagacctgccagcaaagctcctaatcctgttgttgcatcgccttcatctttatagcttacaacttcttcgccgcttgtatcttcctcttccggagcaacttcctctaaagccttcatgctgagactaatcttgccattctcaacttttaatactttaacattgacttcctgcccagcttttaaaacttctgctggagattcgatacgtttctgtgcaatctgagaaatgtgtaccagaccggaaatgtcattgccgagatcaacgaaagcgccgtaaggcatgagagattctactttaccagtaagaacagcgccagcttcaattgcgttgatacgcgcttctttttctgcccgctttttatcgtaaagaacttcttttacagataatacgagacgattcttttctgggtcagctgtgataactttcgcttcaacagtctttcctagatatggatttgtgtcttctacataaccaatttcaagatgggatgcaggaataaaaccgcgaagcccatcaacataaacgataacacctttatttacgataccgccgacttttaaagtaagaacagtaccatcctctaaatactgctgtactttatcccaagcgttaaatccagtttcttcttctgtagcctctccctcattctccacaacattcagtgttttaagagattcgtcaatttctttttcgaaatctgccattgattcactcatgatatcatcctcttttcttaaaaataaattactataaatcagttagtttcctgacaactattataacataagttcgaatactttgacaaaaaaattaaattcgatatataatcatattataacaaatttgagttacagagagcagagggtaaaaaagtgaagaagccagctgcgctcatctgtgctacggatgatacaggaaaaaccagtcagtcagatacaggttaatccgtatgaatttatcgaacgagagagtgtgagataagattttaatgttgagtcatttgtttgtcacggcattctctccacagaatactataataaaaaacgcaggtgtttattatgccagatgtaggaaccttacaggtatctcttgtttccaaccgggggaaacgcccgattacggatgctgcagtggagatttcttctgcgggggaaccggataaaatattagaagtattaaaaacagatttgtcgggacagacagaagtgattgagttagagacccctcctttagaatattcaatggaaccaggactgaatcagccatactcagagtataacttaaaaataacagctccaggatttgagccagtggaaattgcaggaagtcagatgctttccgggcagcttgctttgcagaatctctctttggaaccgacaattacagaaacggcttcgtatgaagttcttgcaatcggccagcacacattatatggagattatccaccaaaaatcgcagagagcgaggttaaggatattcaggcaacaggcgaggttgtattgagcagagttgtaatcccggagtatgttatagtacatgatggagccgtttctgataatacggcaaagaattattatgtactatataaagattatattaaaaatgtagcttcctgcgaaatttattctacatggccaaaagaaactttgagggcaaatatattggcgattatgtcatttacgttaaacagggtttacactgaatggtatcggagccattgttcattcatggttggaaagtgcggtagtgcaggcattttctttttgcttttgtttgctttttaaagtagaatatcgtgatccggaagatagttactatgatgaagccgaatttgcaatcgtaaaaggaaataccgtatttggaaatctgatggacgatgttcggttttatggggagcttgcactggtaaggggaggaattgagaaaattcatgaagcattaccggactataagtatgtaccgatgcgggatgttcgggaagcaatgtatccagagaagatgaccacagaacagctggcagaggcagtggatgagattgcagaagcatttgatccgtatgagtatcgagataatgtggagataggagaaaatacggtacaggaagtgatgctggatttgcgaagtggaaatattcattcctatatttcgtatctgaaggatatcgtagacgaagaatgcgaccagtctgttcgtgcaggtgtattgatggaaaggctgaaagcctatgaaccggagcttccaaaggatatggaaccaatggtgtatgtaaactattgtgaagagagtggtctcatgaatccgagatgtcagaagttatctgatctggattcaaaaaccgtagaacaggacaaagtctgttatgctgatcgtgctcccaacaccaacgaaccaaaaacgatagcacagatgttttttacagtatattatgcagaaaaaggcgaccagatgctgcatcatttcaaagggaaaatagatattggcactggcaacggaggtcttctcaatcagttaaagctgcagaatgaaatgagactgacggatgaaagttggattaactatcagaaaggcaaggggaatgaagagttccagaaatatatggaagatctgacggatatgcagaatcatgttttgccttatctgcagagtttttgtagtctggaaaaaaaggagtgcaggaacgccgggaacagcaggtaatggacaagaagcagagcagagcaactgccgttactggtgtagaaaaatcagcaaatgtaaaagatgcagggaaagtggaaaggaagtctttgccacagaagaaagtagcgataggaaaagagaagaagccatctatccatgaacggttggaaatcaataagaagattattcaagaaaaacagggaaaagataagccggagagagaagctgattttggtgtaaggacagtgtagtataagcacaatgagtcggaggtcacggatgataacgtggcttccggatatggaagtgttccgtaaccttccattaagtgtaataagcgttatttttctttattttctgatgtttagtatattctggctctggacctacagaaccaatcaggcacatcagaaaaaggaacaggaaaaagatgaaaaatataaagcagaacttctgatagctgcaaaaaaggcagaagccgccaatgaggcaaaaacgaagtttctccaacggatgagccatgatatcaggactccaatcaatggaatctgcgggatgattgatatggcagagcattatgcagacgatatggagaaacagacagaatacagagcaaagatcaaagaggcatccaatctgctgctggaactggtaaatgatgttctggatatgagtaagccggagtctggtgaagttgttctggaagagagtccatttaatctgaacaaaatttttgaggaagtgcttgttgtgattgaacagattgctgcagaacagaatatccgaattgtatgggagaaaaaagaaatcaaacactgtgatcttattggaagtccgaggtatgtgaaacgtgtgatgatgaatatcctgtcgaatgcggtgaaatataacggagaaaacgggcagatttatatcagctgcagggaaattccatccgaacagccggaaatgacgacaatggaatttgtctgccgggataccggaatcggaatgacagggacggttttatcatcaatgacagcaacagtcgcacaaacagtaaaaaaagatggtcatatgagcagttgagcagacagatgcggaatctatgggccatgtataactgaagggaaaagccagatgttgaacagcttttgaacagtgatactaccatatttttcatatagcagcgattgaaacacaaggattttagaatttagatatttttctaaatagttgttgacaattctgtttcgtcagaatatattatatttagaaatatttctaaatacttttgaaagaagtgatgctatggcttttgcagatacttttaaggccttgtccgatcctgcacgccgagaaatcttacagttattaaagaatggccgaatgtccgccggagaaattggtagtcattttcatatgaccggtgctactgtttcctatcatctaaagattttgaaaaaggctgatctgatatgggaaacaaaagaaaagaattttatttactatgatttgaatacttccgttgtagaagaattacttctatggttaaaagacttgaaaggagacgaatctcatgatgaaaaaatataaatggtctttgttacttggcagccttctttctttaagcccaatcttgatcggattgcttttgtggaatcagcttccggcaaagctccctacccatttttccactggaaatactccagatggctggagcagcaaggcaattaccgttttcggacttccgctttttatgtttgcaatgatgtggttttgctttcttttcacccatgttgatccaaaacgccagaacatcagtccgaagctgatccgggcacttgtgtggttcatggctgcactttccccgattgttgtgtgctctagctatgctattgctcttggaataaatgtgaatattactctgctcacttatctgatcattggactcatgcttttggtaattggcaattatctggcaaaaacaaaacagaactatagtgctggcattcggattccatggacactgtccagtgaagaaaactggaatcgcacacaccgtgtcagctccagactgtttatcttttgtggcctagctatgatcgccaatggatttctggactctaagatactgttatttttcatcatggcagtgttgattgtaatcccatatgcatattcttttttcttatttaaaaaaggaatatgatgtacacttttggaacatgcctttgtagctgcaataagggcatattatagtaatggtgtagattttattgagcctttggatgttagtaccattttcgggaatggacttgataacgccatagaagcaagtgaaaaacttcctgaagaacagagggcgatacttgtgaaagcggggaaaatgcaaaacttcttttctgtactgattgaaaataactgcttgcaggatagcggaaacacaaagagccgtaccacaaagaatgatgattttcttcacggtttcggtatttctaatatgcgaaaagccgttgagaaatatgatggtcagttgatgaccaaatgcgaaaacgggaaatttacattgaaaattttaatactaattccataaagaatatggcttatgagcctgttgtctatcacggacagcaggcttttttgcgtagttatattagaattgagcgagctaagcgagcgatgcttcttgaacgacagttcaagaagatggtggctattagaatttacgctttcagtattagaatttgcgtcttgtcttgtattctttatttaataggatattggttagcttgtctcgtgtgtaaagtggaataaaaccttgttcttgtatatcggcgaaattcattgttctcaatttatccaagagtgcctcgtagctgaaggcatttcccagatctctttcgaggtaacgtatattaccaccgcaagaaaacagataaggaaatgggcttttatgcgtacgtcatcgtgaagaaaaactggtcttgtttcaaagtcagtcttcattacacgaaaacattcctcgattttccaacgaccttcgctgaattttaggatatcttttacatcaccgtctaagaggtctgtagttactgcgtacatcccatcatataaggcttaccgtgccgggtggaacccctgcaactgtgctatgtgtattttctctacaccgaagctgtttgccgggattcgcaaattatatccagaagaatatcagttgttaaagcataatgaagaaattctggaatttatgctggataataagtgtgatttggatacctttgtgggaaatgcgaaatcctgtgtgtatcatggagatgagaaagcgattcgcagtctggtcactggagaattctcggcaaacgatatctatgcaaaaggacagtggatgtatccggcaggggcatttcatggggtagaaggagagccatgttgaaggaatgatagaataccagtttattcaagtgatgaaacaaaaaattcatagaagagtattctcctatatcaagcacatttgctgcatagatggaatatctttatgaaatcttcaaaattgattgatattatgaaaaaaagaaaggatgattataaatatgaatatgattttaaaaacaacaaatctctgcaaatcgttcaacgggcagacagccgtaaataacatatcgctgaacattgaaagaaattccgtctatggattgttaggaccaaatggagccggaaaatctacaacactcaaaatgataacaggtattttgagacccacatctgggagtattgagtttgacggccacgcatggaaacgcagcgacttaaaccatattggagcgttaattgaaatgccgccgctttatgaaaatttgaccgcctatgaaaatctgaaagtaaggactgctattttagggctgacagataagcggattgacgaagtgctgcaaatcgtccggctgacggaaacaggcaagaaaagagccggacagttttctcttggtatgaaacagcgtcttggaattgcagttgcattactaaacaacccgaagctgctcatacttgatgaaccaaccaacgggcttgacccgattgggattgaagaacttagagagcttatccgttcctttcctgcaaagggtattaccgttattttatcaagtcatattctctccgaggtacaacagaccgctgaccacatcggcattattgcgggcggcatcttaggctatgaggggaaacttaatgcaaacgaaaatttggaacagctttttatggacgttgtaaaaagcaatcacagggagggttaaggcatggactatctaaaatcagaacatttgaaattcaagaggacaatatcgaacaaactgattttcattgttccgctaattacggctatttttgcatggattatgggtggatatatggggtatcagtacatgacgctttactggtggtatgcgttcctgcttcctggagcaatcgcaattttgtgttctttgtcacacagaaaagaagaaaacgcagggaaatactattcggtattttctatgcctgtaaacctttcgagatttgaatttgctaagggcattatcttagtcgaaaaactgcttgtttcagcgatatttttagcattgcttatttctatcagtaatatcattgctccggcaacggcagtatattctcttttacacagcattacaggaagtatcggaattatccttgcgtctgtctggcaaatccctttgtgtctgtacttagcacgcaaaacgggaatgtttgtgccgattgtgttaaatacaatacttgggattgtcctatctactgctaccgcattaggaaatacagtagcatggtggtttgtaccgtattgttgggcagcaaaactggcagagccacttatgggaattgaaatgaacggaacttatgcggggaattgtggattttctatagccattatgatttccatttcgttgtcaatactcttgtttcttattttatcctatgccgacgcaaaggatttttccaaagggaggtagacagaaatgggttttatttatgtgcttcgttctgaacaggaaaaaacgaagcatacatcgttttgggctattcatttttgtgtacccgttatggggcattgttatttcttgcttactattccctgtatgccagcaccgcagacagtaaaaagctcaaaatgatattggaaattactacaacgttttttccgttgttgataagcgttattgttggtctgaacgttgcactggaagaaaaggcttcacacttccaaacgctgcttgctgtaccaaacagacacaaaaatatgcttgcaaaattaacttatctttatggttcgggggtatttgcattgttctttctgttcctgttatttgtgattggcatacatcttttgggaatggctgatacagtgcagctcggaatgctcattggagccgccgccgggatggccttttgtaatttgataatatacatcttgcacctgttccttagcttcaaatttggattagggttatccctgttttggggcgtgtttgaaagtctgcaatgtatcttatatagcaatattgagctgaaaggtgtagcccggtatatcccctttgcatggtctatgaattgggtacaggatattttgagccgacaaattttcaactatggaacggaaaaaatatggattgcagcattaacgacaggcggcttattgctgaccttattatggttttctcattgggagggaagaaaaaattatgaataaaagcaaaaaaataatgctacttctgctgtttacctttatcgtttgtgtggctcttgctggctgtactttacaggacagaatcgaagaatattccagtgacaaggaacaatgttatttgaatacggaaaatgtaacacgtttttcctataaaggtaacgattacaccattttggcagataccgtatcaaatggcgggcttggagaatggattggatatatccggcagcttgccgccatagacgagaacggaaaaatattgctgcaagaaaatgttgaaccggcaacttttcaatccttagcggatttggcggagaaagcaccagaagccgcttacattattccttttctcaatgtatatgcggcttctaacgcagacgattatcttattgtagatgtaaacggagggtatcataaagctgttatcagcgaaaatgtcaaagatagcgatactgtttttgattttaagaaaacagaagaatctataaatgacagctttgaagtcaatccagaaaatgcgacacaacttctttggggcgggacggtttatcaagtaacgtctgatatggtatcagatgatgaattaggcagctacattgatattctcgctgaaagtgttacattcgatacagaaacgaaaatccctttgtcaaaagaagatttaagcaagattgactggtacggggaaaatgccggacaggggcgagagtcttggttttacacagatgtctatgagatttacggaaccgataaagcggaagcggttgcggtcaatgtaaatgataactactatattgcaaagcgacaatgacagctttcctgcccttggagcttgtgctatactaaaaaggacaacgaaaggaggcaacaatatggcggcgatccttatgattgatgatgaacgggctattttagagcttgtcaaaaacgggctgcgaaaggatgggcatttcgtgaccacttatacctctgccgcacaggtaccgcttgataagctgaacagatatgacttgattatactggatattatgatgccagatgtagacggcttttcctattgtgataaaattcgttcccttgtagactgtcctattctttttctgacagcaaagacaatggagcatgacatcacatttgggcttggtctgggagcagacgactatctgacaaaaccatttcgtattgcagaattgcgggcgagagtaaacgcccacctacggcgtgaacgtagggaacgacataccgcacttacctttgaccgcataaaaattgatttatctgaaaaagaattacgggtagataacacgcctgttgccttaacaaaaagcgaatatctgatttgtgaatatcttgcaaggaataaaggacaggtattttcaaaagaacagatttacgaagctgttttcagcttagagggcgacagtgataattctacgatttctactcatatcaagaatatccggtcaaaattgaacaaactggatattcagccgatagcgacagtctgggggattggatataaatgggaatgaaaaaaacaacatcactgaaagcgtctttttggaaattcttatgtatgctgttgattggactaataggtgcggtggcaataccatttagtcttattttagctggaactagtacagggcttattacctatgcggattattcagaacgctgcacaaaagatcttgctcctgttattgctgcaacgccggatttggcagatgtgcagcttcctatgggctgtgaatatttggtgctggataaaaattatcaagtgacggaaacgaccttagagggcgacgatttggaccgggctatggaatacgcaatatccgggcagataaatacaaacctcaacaaacagtatttgcttgtgacccgcaaaaatgaatatgtagtgctgcaatattacataggttcacagtttacaaatgaatggctttatgagcattttccctcaccggaaattctgctttatatttttatagcaatcaactgtattgcagtatgcgtgatattgacagcgaagtttgcaaaaaatatgcggacgcagctctctccgctttttgaagcgacaaggcaggtagcagaacaaaatcttgattttgaagtgggacattcaaaaatcaaagaatttgaggacgtactttgttcttttgcaaatatgaaagataatctgaaaatatctttagagaagcaatggaacgcggaacagttacagagagaacagattgcagcactcgctcacgatttgaaaacacctttgaccgtcattcaaggaaatattgatttgataaatgaaacggagctagacgacgaacaacgtctatatgcgggttacatcactgaaagctccgaacagataggcatttatattaaagtgttaattgacatttcacggacaatcgccgggtatcagcttcatttggagaaatttgatatagctgattacatgggccagattaaagcgcaggcaagctctttatgccttaccaaaggaatttgtctgcaactggaaacgggggctaacctgggcacacttaaggcggataagctgctgttggaacgggcaattatgaacgtgataagcaatgcgttagactattctccaccacaggggacaatttatgtaacggtgcaaaaaacggactgctttttacatatatctataacggacgagggaggcggcttcacaccggaggccctacatcatgcacagaaacagtttttcatgggcgacaaaagccgtacttctaatatgcactttggtatgggactttatatcacaagcagcattatcaagcaacatgacgggcagcttgttttaagcaattctaaaaagactggcggcgcacaggttattatcaaaattccatattaaaagtagtaggcggtactgcggtatcgcttctgcaccttgcgtgctataaaacgtagtctgcaaaggagtttgagtaatccgtttcaatctaatagataaaaaagaaaccgacataaagccggcttcaaaagaaagtaaaatcacaaaactccccggaaatatgaccgaggagtttttgtgattatttttctggtaataattttcccattgtgttggcgatgtcttttaacttttcaacagaatagcctgtatataaaataattttgtctaaaggttcttcattttcaatcatcatctgagcaagggaatagctttttttatcttcgcctaacgctacaagaccattactaagattacacatattttgcacctcgctttcaaattcttctgtcattgcaatatgaaaatcatcgtttagacgctgctttttttcttctggagatgtagagggtgagaagagtacatttagtaaatcaagaatctccaaatcactttctttatcagcatcaccaagatttaaaataacaacttccattaaatcataactttcaggggaagtgtagggagtgccatgtatggtatcttcaacagtatgatatttaaaaataccatttttccgcttctttgctgggtcaggacatatccatatactatatactttttgaattttctcataatgttcatcagtaaacactgttccgtattgttcagaaatcattcgagcacaataataaaatcctcgtgttactaatggataacccggtgtatcatttaattggatttcaagatttataatgagttgtacaggctcatcactgtctggtagacaggctttgaaacgaatatcatagtatacagtctgttcattgatagagtttgcttcggtgttaagtccgtcaattcgttggttgccatttaatcgagtgtttttatcgaggtaatcttgatgtacagagcgttgtgatatttcaatgtctcctgttaagcagttatcgcatataaattgaacactatattgcgagaattcttttgtacaggattttagtatccatgcaataacggcattataagttaatagtttttttgcacattcgtcatacttggctctgtctgcggttaaatcaatagtatgtgcaatatttgtttgctttagaattataatcacctccgatatactgatattatgtaagtctatgttaacataattatctttaattcgctatacttaatctcaagaaaatgtaaataaattccaacaatgtaatgactaaatttaaaaatattaagtgtatagtgtaatactgtcaggcttgggatatatctgaggtgtcattggaacataggaaatatcctctttttagcgaaagtaaataaattcagtgatatattataagcttgtatacattataattggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgtacactgtctaaggtatttccatacttgaattccgttacatcggtaacccatttctcattaaggtgttccgccttaaattctctattaagaatgttttctgcaataaatgctgggttgtttgaggctctggtacagccattataccggctctttaagttggaccagatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatattttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgagcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttcaactgtctacctaaaagggagcataccaaatcttacatcatgcatttatgcatgagacttttttcattgtggtaaaaagaaagggggattgcaggagcgtatcaggatgatagattaaaaaagaaaccgacataaagccggcttcaaaagagaggaaagtatgaaaaaaatctatcaaaaatctgttgttgtttttgatggttttatgatactggaaatttgtgaacaggttgtgagcaaagaatgaagataatctgacgaaaaaagaaattgctgacgtttttctgtaagaaatagaatagggcagtagtatcaaaagaaacctataacgaaatagtgtcaaaagtggaccgttgggtttggcaaatcatataaaagtgagtgtcaaatctaacggtcgttttttgtgatacggaaaggaaaagaatcatgggaaagatttatgggtatgtgcgaatttcaactaagaaacaaaacatggagagacagattcggaatattcaaaaagagtatcccgaagcggtcattataaaagaagtgtatacaggaataaagtttcaaggcagaaaggaattaaataaactgataaagcaattaaaggcgggggataccgtagtgtttgactcagtatcaagaatgagtcgtgatgcagaagaagggtttcaagtatatcaagatttatataagaaaggaatagagcttattttcttaaaagagcatcacattgatacaatgacatataaagcggctctgcataatgggattccgcttacaggaacaaatgtggattatattttagaaggagttaataaatatctgatgtcattagcaaaagagcagataaggcttgcgttcttacagtcacaaaaggaagttacggatttgcggcaaagaacaaaggaaggaattgagacagcccggataaatggcaagcacataggtttagcatcgggaacaaagcttgttacaaagagatccatcgaatgtaaggaaaagattcagaaatatagcagagattttgatgggatgctgagtgataaagagtgtatacagcttattggaattgcacgaggaacgtattataaatataaaagagaaataaaagacggaatttgttaaaagtagattatgcaattaaaattatcatagcaggttggacagatgatagcataagaaaactgatttttaattacattacagggaaggatgaggattgattcatccttcccttttttcgactttttttattttccatagcaactccattaaagttggattttaattatttaactttctaccgtaaattctcaaatcataatgatacaccatcttcctgtaacaagagtaatattccattaccataaggaggatatatccaatgggaattattaaatcaatcgtaactatcattattgtcattacaggaagaaaaggaggaaagtaagatggcagcaaatgtagaaagtatgttttatacaagaacggcaccctggcatggattaggagtcagggtagaagaagtactaggttctaaagaagcattgattcaggcaggactcgactggaaagtagagcagaccgatgtatatgcagcatcaggagaaagaattccaggatataaagccaatatccgagatattgaccgtagcgtattaggaatcgtgggtgacagatataagattgtccagaatgaagaagctttcgcttttacagatggattgctgggagaaggggtaaagtacgaaactgccggaagtcttgccggagggaaaatcgtctggatgcttgcaaaacttccagagaaatacattatctctggagatgctattgaaccatatctagtgttctgcaactctcatgatggttcaggtgcaattcgtgtcgctatgacacctgtacgtgttgtatgccagaatacacttaatctggcattaaaaggtgcaagtcgtgtatggtccgccagacatacgggcaatgtaatgagtcgtatggatgaagcaagagagacattacagcttgccaatgcctatatgtcacaattaggacggtctattaatgaattacaggctaagaagcttacggataagaaagtacttgctatgattgattctctgtatccagtcagtgaggatttaagcgagatgcagaagaaaaataatttaaaacagcaagagatattaaaagcctgctattttgatgcacctgatctgcagggagtaggaaagaatgggtatcgctttattaatgcggtatccgatatggcttatcatggtaaaccattacgtcagacaaagaactataatgagaatttattcaggaaaacgattgacggtctgccagtcttagataagacatatcagatggtgttatcggcataaagggagggaataaagttgaatccagtaaaagatgtagttgaagggaaaattctttcagagatgaaaaagtacagacaatcaaatagttttacaaccactacaaccggctgtgatactggagatacagaaaacacaggacatccggtctatgaaattttctgtatcattttaaagaaatttgacccagtactcttagaaaagttattaggggtagccgatttatttgaatacttaaagcagttatggaacaagtcagagaaaacagaagaaaagaaaggtgaggaaagataatgaaaacattagaacaggaagtattaaagaaaattgcaaaaaagagtttatttgtaaagctggttaatacagaaagaaatgagtcattagttgagcagtccatatcaaaagaatttttagatctttccgcagtcgtaagagttgttctgaaaatggataaagaaggaatggcttcaatggcattatcaaaaggggatgctgaaatcttaggtatgaccgaagaagaaatttatgctgcggcattggcaaatacattaagacttttcccacctaaattaatgaatttagggcgatatgtagaaatgagtattggagcaaagcttccactgggagaagatgaagtaacaacatatatccttaccaatcaaaaggaagtggatggagcgatctattttatgagtccagaagtagttggagccattgctgaggcattagaagatgatttatatatccttccatcttccgtaaatgaggttcttcttgtaagagcaagtgaactggaagacggagtcgatgaactgaaagaaatggttcgagatgccaatgaaaccgttgtggctgaaaaagatattttaagttataacgtatatcattatgacaaagaacatggcattaccattgcagcataaaggaaggggcagttaaaaatgaaatacgatattgtgtgttccacgaaaaatttatcaacagaagaatggctgaaaataagaacgcttggaataggcggcagtgatgcaggtatcattgccggatgtaatccttaccgcagcatctttgagttatggcaggagaaacgtggggagattccagtaagagaagaagaatccgaagtaacgcatttcggtaaggttcttgaagatgtcgtaagaaaggagttcatccagcgtacaggcttaatggtaagaaagaaaaattccattcttagaagcaaagaatatccttttatgattgcagatgttgacggcattatcagtgaattggatggtacttattcgatatttgaagctaaaacagctatcgaatttaaaaataatgactggaagaatggagagattcctaaagcttatcagttacaggttcaacactatctggcagttacaggttttcagaaagcgtatattgcggttctggtcggcggaaataaattctattggacggaagtataccgggatgaacagcttatcaagatgctggtaagcatggaatcccacttctggcattgtgtccgggagggggaagaaccagatgtggatgcttctaaggctacaagcctttatctgggggcaaaatacaataatgcgaaggtcggttctgtcattgatttggatgaacagatgctttcagctattgaaaaatatgagcagataaaaatagaattagattcattaacagagcagaaacggcttgttgaaaatcagttaaaatctgcattagcagaaaatgaagccggcagagtaggaggacatatcgtaaaatggaaacaggtagttcagaccaggattgattcgagtaaactcaaagaaaaacataaagatatttacgatgactgcaaaaaagaagtaacttaccgtaagttttcagtagcatgatagtaaaaagactgtgagagggtatctataatggtatcctctcttttttggaggtataaaatgaagaagattcgggaattaagagcagatgagattgaagttcgtgtaggtgttgttaggaaaaacggtatatcattattgctgtacaaggatgcacgttgtgatatgaatatattagatgaaacattcggaatcgcaggctggcaacggaaacatgaactgataaacggggcgttattctgtacggttagcatcaaagacgagaatggagaatggatttctaaacaggatgtaggagtagagtcttacacagaagcagtaaaaggagccgcatcagattcttttaaacgtgcctgttttaatatcggcataggcagggaactttataccgccccgtttatctggattccgtcagataaagtaagtattgcagagggcaatggaaagttaaaagtaagagattcttttaatgtgtcatacatttcctatgatgaaaatgggaaagtcattaaaagtctggaaatccgcaatcaaaagaatgagattgtatgtcagtttaacatggggaataaagtttctaaacaggcttttcaaacggcaaataaaaaccagctttccgattatcgtatgggaaaactgtatgatgaaatgaaacgtacaggtgtgacagaacagcagattgtagaacgctttcatgtatctttggcgaatttaacagagagagattataagagggtaatgagtgcgttaaagaatacagatacaagagcagcataagaaaggagattgtcatggagaaaaataaatttattgaagaattattctatgaattatcgtgtcagttaggtaaagaatttgagatgaaacagaagcgtgtctggaagaataacggtgtatcttatgaaggattggttattgaaaagctggaagaggagttatcgcctgttgtttctttagacaggtgctatgaagattttcaggcaggaatcagtgtgcaggagattagcgaacaggttttaaaagagtaccgcaggacagcggggaacatttcgttattaagtcagcaggatatatggagttatgagcggattaaagaccggctctatgtagagatggtgaacaaagaatggaacgagcagtacttggagcataaatactatgttccatttcttgatttagcggtcgtgtattacatagatacacagccagattacaaagaggctcagtcacatcgagggactgcggtaacaaaggacatttttaaaatctggtcggtagagccggaagtaatatggaaacaggttttagaaaacatgggaaaagaaagcctgtttttgatgctgatcgtgacagaggaagaaaattcacttatgactttggaagatgttttgcagaaaaatcaaggagcattagctttattacaaaagagtgtcttagatgaagcaaagaaaaagattggagagtcattttatatgctgcctgtttcaatttttgagttaatgatagttcccgaaagtcaggcagatgaagtggaggagatgaaaaaagcaattattgaatctaataaagaactgccagcggaataccttctttcaaatagtgtgtattattatggagacaaaggagaggcagagatagcaggttaggcatataataaaaacaggaagaagcatgatgtttcttcctgttttttatgtaaaaatatttatcaaataaaattttaaaattagtctgcaacggataggaataaaccgttttgaacagcaatgaacacatttttaaaaagaaatgaacgaggtgataacttatgtatgagtacattccagaggtaatgacattcaaagaatgtaaagaattgttaaaagtcggaaaaaatactttgcttgatttaatacacagcggacaaatatcagcattcaaaatagggaaccgttggaaaatagcaaaacagtctgtaattgagtttattcgatacagataagtctatgttattattttttcttgtgataatatatagctatacagaattatatagatacaggatgagagcaaatgtgtaatttaagtcaaggagtagaagaaagaggtattgaaaaaggattagccgaagccgttcttagaatatataaaaaaggttattcaatagaacagattagtgatctgctggatatgaatattgaaaaaataaaggctattatagagagtaagtagtttgaaaaaataaaaaatactgtcaaagttaaaaagagctttggcagtattttttttatgttataatgagtataaaattagctaaattcgtaattattgaaatagaaaaattgtgcttaaaaggggcagataaatgagtcagattacagaaattacaagaagggatatatatgatttatttcatgatggatattatatatcagaatggcatagtgaattaataaagtatccatactatggtaatacagacaagctgttagctttttatacatatatagcggattcttttggagcaaacatgaatagctggcttggcagaataactagagatacaaacgtaaacggttcagcaatgcctgtagatttactgattaattttgctcaggattatgcggaaagaggctataatcatgatacaattaaaagaattttttcagtgaatcgtgaagtcagactttctgatattcaaagctaatggataatctgactccaaagcaaaggcggaagaatatgcaacatattcattctaaagatactaagattgaagttgtgcttagaaaagctttgtgggcaaagggttataggtatcgaaaaaattggagtgagttgccgggaaagccagatattgtccttataaaatataaaatagcgatattttgtgactcagagttttttcatggaaaagattgggaagttttaaaacctcgcttagaaaagggaaacaatccagattactggattcctaaaataactcgcaatatggaaagagatatggaaacagataagaaattgctttttttaggttggacagtattgcattttttggggaaagatatattgaagcatccggaagagtgtatacaggttgtagaagaaacaattttggcacaaaaaatagagttggatgcttacttataagaaaaatagaaaatttatttaaaaaaagtaaaataaaaatttttaaagggtgggttagatgtattataaatatgaggtaagtagtaggattttagatgcgattgataatttgggtgaattctattttcaaattgttttgcgagaaaatatgccttttatattaggagactgttattttgtggttaagaaataccataatcaagtttgctatatttctgatagtttacagattagttattattcggaaagagacaatcagaatgaggctatgagaaaaatcagggtagcattagagttttttgtttatttaacgggaaatccatataacagtgaaggtggaatgacaaagtcaattgttgatgcacgtccgattattgatattaacaaaagcaagaggaagttattaaaaatacaggaaacagaaactgcatatcaaagaattaggcaaaagagaaaattgttagaaagtacattacaactttataacctagggataagattaaattttttatttggtgatgaaaattgtgaggatgcattttttacatttttcaaaataattgagaaaatagtatcagatgaatttgatattgaaaaagagggaattgatagaggaaaagaagaaacaaaagagtgcttagaaagaatattaagtcaaacatataatattcaaataacagaggaaagattaactaaattcagtggggagattagtaattacatttttaatattgtatttggtgataattattataggataatgtggttctgtcaaaaatataatataagtgttgattgtaacataatatcaaaacttgttgtaataagaaataaaattgcacatgcagagaaggtgacaataagtggagatgaatatgcatatataatgaaattgactagagaagtaattaatgccaaatttttttcaaaaaagccattaatcatagattcaaagattataaatatatgaatagaaaatttagtaattacttaataaaaatttttgtatagttcaaaataaaatactgccggaaactttttggaattagcttctggcaatattttattttaaaaacatatgtttaattacaatatttgtcggtgttcttagctaagagcatcggcatttcctttttttaaataatctattttagatagttttgcttgtggacaaggaaaattagaaaataaatagattgtgctgtttgtgcggagtaatcttgaacgtcctatggcttgttccaattctgttgatatgaggtaaaactggatgttacacagtaatttatcttcatatgacatcattggaaaacagtacccattaaaagagactgtcctgcgtcgtagaatttgtttgtgcaaattttttccagttccatgtatgtaacaggcagctagtttatatacactttcgggaagatgatatgttccaacaataattccatcttttcctgcgtaataatcaattcctgctacatttccaaaatgtaataaacttgttaagaaaggctatgcgcgtgtttactaggtatatggcaaatataagtatactaataagttaagagcttctgaaaagattgccaagcgaaagaagttgggaatttggaaaaattataaggcagcttttccagatagtaagagttcttctaataagaagactacgaagaaaactacaacaaaaaaagtttctaatacaaagaagaatagcagtaaacagacatcttcatcttcttatgtgtggattccacgcacaggaagtaaatatcattctcgttcttcatgcagtaatatgagaagtccgagcaaggtgaagaaatcggaagccattagcagagggtatacaccttgcagtaaatgttattaagatattttataaaaggaataccatcataacataaaaatctgacggtattccttttatttaaaagaacatagtattaatcaagtaattgtcgatgttcccttctgggtcatcggcatcttttaaataatcaatattacaaaatgtagcttgattgcaagggaagttagaaaacacatagacagtactgtttgtacgcaataatcgtgagcgaccaacagcctgttctaattcagacgaaattagatatagttgaattttttgtaaaatcttatttttgtaagacatcattataaaatcatatcccttatagctaacttgtctatttttatatgaatttttgcttttttccgatatgccaacagaataagcaatcaattcataaagatatgtaggaaaatggggtgttccaataattatcccatttttcccagataaataatcagtacccgtaagatttccaaaatggagtgtataccctaagggaagtgcttcttcatatcttttaaaagtaatgccataaactacgttatttgtgtgagatataattttctcaaatagcatagaaagtgttggataatcggagttctcatccaatacaatgtttttaattgcagttctactcatagagtatgcaggatattgaattaaatttccagtataagcagcttgcttaacttcatgataaataatatttcttgtaggaaagaaaatctcataaattgtttggtctaatgtcgcagataatataatcatcttgcatttgggaagtttgataggaggaagatatttaatatagtcatccaacttcatataacatccggcttttagaaattcagcaatattatcatttgttttacatctttttattatacgagtatcaatttcgttaggaatataatcacgattaatacaacatttcttttcttttaatgccaataagtcttgaatcatttctctttttgcgtatgatagataatttttttccagaatttttttgagagtagaaattttaattgacccaacccgtacaagaatactattatataaaatatcttcatctattattatttcaaatctttttaaaatcttatctggaagtgaaagaagtcgagcatgagtcatgataacacaagaggatgtttgttccaaataaatctggggatttaagtatactctgaatttgttgagttcttctggttcacaaacatcgcgtgcacattcaatgatacattgtctagctttttcaaaatctccctgattataatattgctgaatatcaaatctccttcctatcaatggtaaatcatcaaaagatggaatatcaaatatattttcttttcctattctttgtataagttctgattttaaatcacttgtaggaacggcgattaataatggctttttatattttcctgaattgattgcatcaatatatagtgaggttttcccaattcctgtttgaccggaaattagatgaatttgatctttttttgattttaatgcttcttttaattcataagatatttgcttaaaactttcatctacagaaacaaaatcatgatttccattgaatgtgattagttttttcccttttagtgtttcgacaatattacttctatgattacatgaattacaatatttacaattagagcagcttgctggtttatattctcggtctctcatccagttaagattataacgccatttatttctgtctgagtcaggataatttctttttaatgcatctaaaaaatctttttcaaagccaactatgtataggatgtttgtggctaataaaaatttatcccgatgagataaaatattaccatcaccagatacaaactctttccataatctgcaagagcacattttttcgtaagagactttttcaagtctcttaggtctactctttttgcatacatacttttcagacttttcttcctcttcattgggttcataaaaaataatttttgaagatatgattggaatatctaatttatatttaatattacttccaataatttcttcatttttgattggggggtggataggaacaccctccttgtgggggtgtgcgggatttttatataaaaaatattaaaatgattattactcaatccaatttgatatttgtgagcaaatactcttatatttcttgaaaaattttttttatcatttgtatataaaaatttttcaaattgcattactagattatatacattaaatgtattttcccctgtctccgctacaacatcattgaagtcgattaatccttttccaccgtaaaataatctagcagtttcaaaacagtgactatctgcctctggaaacattttttttaacatttttaaaatcatatcagctaaccatctttctgtaattggaacgatatgacataagataattctatattttgggtgttctggagtagaactaaacgtatgataagaaaatacaatcggcaaatgatagtctgcaaattttcttttaattttttcatagtctggttcttcatcaaaatctataccaaataattggcattgctcaaaattttcttgtttacttgccattcctttaaaggttgcagggagaaaagcttgaccttgttcgcctacgcaatctgcgatagtttttatatcataataattttcttcttgtggtaaacgcattctcattttttttgcatcactgtctgttggcttgcttgtatagcagtacttatcaactgttgctttaattttcatttttcttgccttctttctttttaatatttaaaaagtgttatagatttaattattttttattagaaatgggagaaaaggcttgttttatgtattttttcaacatgggaaaaggatgtagatggttatacggggcatcttgtataaccatctacatcacaacaattaatggaatttatggatgtgattggaattataatttgcggattctaatttttatttttatattttctttggagtatgggcgattttcccatattgtagaaaaaaattagacagaataaattttatgtgatttaataaaaggggaggcataaaaatgacatttacagaatggataaatacacaagaggatatatgtagtaaactaagagagcaaggatacgaagaaaagaatgacattcgtaaattttttaatgatagaattagatgtattttaaacacacgtgatatacctctcaaaaatttgtcacctaaaagaagttacgaacgaatatttcaaattaatagggataacgagagaaaatgtttttttccagaactattcaaagaagacgatgaagaagataatacagaagcagaagagaaagaaaaaaattgaacaaaaagtgaaacacattgaaaaatatagatacatatagcctaaaaaagagatcttaaggaaatctttaagaaaatttttctggaaaatggaacaaaataagaggaggagacagccatgggtgttgtaatcggaagaatggacgggcaggttgaaaagatatttttgggtaacaatttaacaagaagtacaaaaaattatgctaaaatcttgaaagatgagagcttgtcagaagaggaaaaacagcgtattctagcagcagagaagaaaaaacaggaagaggatatcattttatgaagatttcagtagcaatggcatattataatggcggtacatatatagaagaacagatggactctatcttatcacagcttggaaatcaggatgaggtgattgtatctgtagatggggcgagtgatggttcagagcccattctattgaatatggaaaaaaaggattgccgaattcaagttataaagggtccaggtaaaggagtagtgaagaattttgaaaatgcgattcggcattgtacaggggatattatttatttatccgatcaggatgatatatggaagcccgataaggtgaaaaaggtgaatgcagcctttgataatttagaagtaaaagcaattcttcatgatgcagagattatagatgagaatggaaaggcaacaggagcagaaagtctttttgctttaaggaaaagtaagccaggtattttaaaaaatcttatcaaaaacagttacgttgggtgttgtatggcatttcgaaaagagcttattccagttatttgcccgattcctaaagaaatgtatatgcatgactactggattggaacagcggcagaatatatgggacaggtttgctttttaaaagacaagctcattggatatcgtaggcattcttctaatgtgacacagatgacacatggaagtattgactttatggtaaaaaagaggattgatattatacgttgccttggtttattgaaaaagcgtgtaagggaaataggataataaatattagagataaaaacagtaaaaagcaaggagaaaaggcaggtaaataaatatatgaacataaaagaagagggaaagaagatatggcagataagaaagaaaataaatagaaaacatattattattctttcttttttcatgccattaatcgttatgattggctgctgtattgcatttggagtacagccatttggagataattcacttttaattattgatgggttgcatcagtatatgccattttattctattttatatgataaattaaaaagtggaggaagtcttttctatagtttccgtgctggacttggaattaattttttatcattatatgcgtactatttatccagccctttgaaccttttaattttattttttaaaaagagtcagttaaatatggcagttagtttgattattgtgttaaaggttgcaatcagcggactgacagcaggaatttacttttcgtcaaagagcaagaaaccagggctccctgttttaatgatttctatggcatatgctttatcgagttatatggttggttactgttggaatgttatgtggcttgatgcgattatgatttttccgattgtcatgatgggattagaagatctgatagataggaaagacggaagattatactgctttgccttattctacgctttatattgcaattactatattgcttttatgatttgtatttttgtagtaatctggtatattttatactcatttaaaagtgtaaagcagttcttcttccggggaatagcatttacattctattcatttctggcagcaggaatggcggcgcttatgcttattccggcatatcttggaattaagcaaacagcatccggggaatccatgagtttgccagagcatagctttttaacgaacgcagcagatttacttaatcggcagtttgcaatgtggacaccaatcacttatgataacttcgatggaaatgcgaatctttatattggtatttttacagttttagcagtggtgctgtatctactaaatagtaagattaaaattagtgaaaaaataaaaaaagtattgttgattggatttttctatttaagcttcagtgagatgattttgaattttatctggcacggattccatgatcagtatggaataccaaatcgtttttcatttttatttggatttgtgctgctgtatatgctttgggaagtctttgaaaacttagaggggacaaaaggatggcatatagccttagcctgtatggcaggagtcggacttttagtatatgccagagcgaaaggaacgaatccacttgatgatgaagtctatggtgtggcaggaatgctttttatcttatatggaatgttattattcttgtatacattgtctcgtaagagaaaaggctggtataaaaatgttttttgcatagtagcacttattgaaattgtagcgacagcatttatgggatttaatgaaaatggacagattgctgttccgaagtttttctatggtgtaaatgatatggaaaaggcggtagcttcactagaagataaaacattttatagaagtgaacttgccagttctctgattgttgatgaaaatgcattatatccaatcaatggtgtagggttatttggttctaccgcttcagatagtatggttaatctgatggacaatctgggattttatacaggttgtaatgaatatctctataaaggcgcgactccggtaacgaatcttcttttaaatgtaaaatatctttattaccatcaggaagatactctgaatacggactttgaatatgtaaagagggaaggcgcgtttaatatttataagaacccagcaagagaaatgtcaatgggatatcttatgaatctttctgtagaagactgggattctgaaagtgcttatccattccgtgtacagaacagtcttggaaagcaggcatttggtgtttcggagctatttcataatgttgagattgctgatccggcaacgaatggctgtacggcatcgaaaacgaatgatggagaatattattttgaatacaaaagcacacaggcagataatatggtctttacgattcctgtcacaaaaacaatagatgatttgtatcttttttatgatggaacacaggtagaaaatgcacagattacaatagatggaacaaacgtaaagtctggagacttagatggatatatgctaccaataggaaaagtatctgctggatctgaagtaaaagtaactttccagctaaagggagagacagagacaggatatgtgcgtctttcagcagcagattttgaccagaaggaatacaataaccttaaagaagaaacagcagacagagcatttatagtcagagattattcaagcaattatatagaaggtaatgtaaatgctaaaacagaccaaactttatttttctcaatcccatatgatgagggatggtacgtagaggtagatggaaaaccagcagatatgtgggcggtaggaaatgcttttcttggaatagatgtttctgccggcgaacataccgtttcgttaagttatacgtcactaggagcctctgcaggatggaaaatcagttctttagcaatagtaatctttttgggtagctgttttgtaaaatctcgatataaatctgatataaaaaagaaagaataaagatagattttggaaatatttttcacctaaagatatggtaaactagaacatgtttgaaaaatgctttctgcaaaatttcccacgagtgtgtagattgcaggaatgatttttcaaacacactctggaaaaagaaaaggaggaaatgatgatgtttagaaagaaattgattgctttatccgctatgctgatagcgggtttactggtatttcaggccaatgtatcagcagatgctatagaggagaagccatatctgtcacttggagcagatttaacggctactcaaaagagaaaagtgttggaacttctggatgttaaggaagacgaatttgatcagtataaagttgtaaaagtaacaaataaagatgagcatgccatcattaaaaattggtatcctttataactaacttttcgattttttagggaaccgtgttctgatataccgatagaaaaggcaatcaactgatatagataggaaggaaaatgtggagttccaataattactccattttttccagaataataatctgtaccagtaaggtttccaaaatgtaaggtgtgttccagaggaatatcattttcatatttcttgaaagtgataccataatatacattgtctgtgttggttattatttttttgaataacgcagaaacagtaggacaatgtagcgtgtttttttctataaagtcgtttatcgtttttctgctcatagaataacaaggatattgaattaagtttcctttataggcagcttgttcaatttcatgataaactatttttctttcaggaaaaaacaagttatagattgtttcatctaatgttgcggatagaataatcatcttacatttaggaagttgaaccggagcaagatatttaatacaatctttctgttttatatagcagtcagcttttgcaaaatcaatgaggttatctgtggttttacaattcttgagtgttcccatatcaagttttagtgaatagagatttctgttacggcagcatttattatcttttaattttaatagttcttcaatctctatttgtttttctggagaaaatacgtttgcttttaaagcttttttgagagaagaaatttgaacagagcagtacgagtaagcatagtatataaaatatcttcatctattaatacttcaaaattttttaatactcgattagggagtgttaaaaaacgggcatgggtcataataacgcattttgaagaatgagctaatgctgtctctggatggagataattcataaatatggaattatcttttgaattatgagaatatgtttttatgctttctaaggcatcattaatgaatcccatactatagttcttttcaatagtttgacgaagttctggtggtaaaggtaaatcctcaaaagagggaatttcaagtactttatctcgaccaattttttgtacgagttcgctctttagattgtttgtaggtactgcaatcaaaaatggctttttgcggggtcttgattttattaacttaacatagattgtcgttttgcctattccggtttgccccggaattaaatgtatatttgtggtattttttttgagtgcagcatttagttcagaagatacctgtgctacgctttcatctacagaaataaagctttgtttattgaaatatgtaatttgttttcttccacacaatgtttctaataaatttgttttatgattacaggtatccttatatttacaatcgttacatccagtgggattataattttgtcttttcatataattaaaatagcctttccatttggatatatcggtatcaggataatacttgttcaacgtatcaaagaatttcttttggtatccagttaaaaagcgaatatttgtagctaatgaaaatcgtgtattgtggtccagtggttccccattaataaaatctctccatagtctacagcaattacaaattttatcattggatacttttttcattatagtaatggctgattttttgcgtatacgctgtgaagaagactctttttttactgcttcttcttgtaattcataaaatatgatttttgaagaagtatttggaatgtataattcatatttaatattgcttcctattttttcttcatttgtattagggtctgttgaaatacaccctctttgagtattgtattcgtaaatatcaaaatgattgttatgtatattaagtttataattacgagcaaataattttaagtttctggaaaaattccttgaatcatgtatataaaggaacttttcaaattcttgtattaaattatacacattgaatgtattttctccagtttcttctatgacttcgtgaaattctattaatccttttccaccgtaaaataatctagcagtttcaaaacagtgtttatctgcttccggaaacatctttttcaacatttttaaaatcatatcggctaaccatttttctgtaattggaacgatatgacataagataatcctatactttggatgttctggagtagaactgaatgtatgataagagaaaacgataggaagatgatattccattaatttctttttaattttttcataatctggttcgtcgtcaaaatctattccgaataattgacattgttcaaaattttcttgtttacttgctagtccttcaaatgttgcagggagaaatgagtgtccatgattccctatgcgttcagcaatggttttaatatcgtaataatcttcttctttgggcaacctttttttcataaaagcggtttgcctattggttggtttacattgaaatgctgttttatcgaaagatattttaatatccataaataaaaactccttcctttaaattaattaggaaggtgtttggagaataatttgtttttattaaaatgcaaaaagaatttttttattttgttcggaatatgggcgattctcccatgttgcaaaaaaaaattagacatgattaggattatgtgatttaataaagaaaagtaatgggggtacatgagaatgacatttaatatgtggataaaaaaacaaaaggatatatacggagagttacaaaatcaacaatatgattcacccaaaaagcaatgggagttttttgataatagaataaattgtgtacttggaacagctaggcactctgaacaatcgtatgaaggtatgtttcaagaaaataaggatagcaggaataatagcaagaaggaagaagaggcaaaaaggggacgcaaacatttagatgaagatatagaatttggagaggaagaacagaaattttttagaaagatatttgaaatgtttcctaccagtgaaaaattgacgttaatagaagaggataaatgggaggaatttgacatagaggatagattagaattatttaatattacagtagatatgctggaaaataatggatattggtttccgcttagttttggtaactgggatttatgtaatcaatgggctggtggtaaatatcaatgcaaagaagatgagttagaagcaaagttattttttccacatatgtatagaattaaaagtaaattaatagaattaaaaggagaaatgcttcaatattcagaattaaataaagataaattgatagatgaagaaaaagaatttgaacaagatttagataggtatttatctatattagatagcagagcaacagagatgagctttattcagagagtaaataaaaaaatagcgaaaatacaacagttacggtgtggtttatttagagaagaaagacttagagaagaaacagatgagagagaaataattacagaggaagatagatacttcgaagctggcttggatagatatttaaattggctagatgaagataaaaatgggattgattatgctcgaagaattataaataaaatagaatatattgaaaaaatgtagagtatatatgatgtgaggtatagcagtgcgcaaataaataaaaatttagatatttcagaactaaaaataacaataccagaggttatactcgaagcaaatgaagatatatataatagatactgtaaactgggtgaaaagatggagcaagatagcaaggaagatgatgtttttgaagaaaaattaaaagagtatatagaacttcttcgtaaagcaggtgaaaggcagagggttggaaaagagtatatagaagagacggcaaaaaaatatgcaaagaaatttaataaaaatgttaatataaaaaattagttagtaaaaaacagtacatggaaatcatatcttagagttgaaactgagatatgatttcttttttgtgtaaaattgtttattatatcataaaaataaaaaaataaaaataggtaaattcgataatgcagaaattaactttttaagaatttttttgtgattaaagaaccgataatatagagacagcttcaaaatacagaggagcggtatcagataccttggactgacgagttcaaaagagtttagttttaggaggattttaaaatgttaaagagagtattaaatacagagctggagaaaaaagtattcgaagatgaaatgatggagaaacttagtgttgttccagcggagtatgaggtttacgaagaatatgcttcacggcaagagaacttcgataaagatttcttcacttattgcaacaaaactccgttgctagtagatgcagatgaagcatcgtatgacgagtcagaggaaaatgtgggcgtgccaaattgtaaggaaaagagtttagaaacatttatggcagaaagtcaggaggagattaataagaaaaagctggaagaggcaagaattaaataccattataaatggagtacacagtatatcagaaagctagaggaggagaatcacagaataagacaaaataattgccgcttggctcgaagaaacgaacggttggaagagaaaaaccaaaatttgttaagcgagtgcaaagatttaaggaaagagaataagtctaaaaaagaaaaattgaaaagacaaaagcaggtcttaaaaaaatacaggaagacagtcttcaagaatattaagaacggcaagtgggataacaaaagaagccgtagactgataagtaagcaggatgtggatgatttgttactgttattgtgatttttattgttacataaaagaggctgcgggctattagtccgcagcattgagagtcgcgtgaaagaaaaaataaaaggagaataatcataatgaattttagttttgtaccgaaccagggtttaatggtagatggaagatatataacagaatttgatgtaaaggtgaatcgaatcttctattacatagaggaggatgagagtaaaaagaaccatatggagtatgaattagtggcaaaaatgcttgatgggacagaattatctccccgtcgggtaaaaaaacttaataacctgtcgtactttactctgtggacagagattatggatgctggattagatagatgggaaaggcagatgcttttattacgtttacagacatcctgtaaggacgcaaagcaggttaagatgtatcatataacttctaatggataccagagattagaagttggtaaagagatattcattgccggtgattatacatatatgtcaaatcaggatgggatacagattgaagttgacgaaaatgttaaacaaatgaaatggaaaaataaggtacgattagcagataagaaaaatgctgatagaaatgaagaagattacctgacagtatcacagggagccagtgaaatcttatttacagcggttttattatcagctataaaattcttatttataaaagcaggttttaatccggcagtgtgcatcaatctttatggaaaaacaggaagttataagaccgctttaacgcaggcgatgatgtatatggaaaatccttcgcagttcatgtgtagtttggtaaatgaccaaaagaagatggcggtgaagaaagtacaacaatgttatggatttcctatggtattggaagattatcaccctgcggcaactggttacgattataagcggcagatctctatgatggatgcagtggtacgtcatatagagagtaatcctcaaagtgcagttgtgtttattacatcagaatttctcgatggggtagaaagtttacagtcaagaactcttcagatagaggctcaaaatgtggatttgaaaacgcttactaaaattcagcaggagcagacgatggcaactattgtaatgaattttttggataaattattaggaaacatgaaagatgcaatagaaaccattcgtactcagtatgaggctttaagcaggcatggagagcagtctatgcgaattgaggaaagcatagtttttcttaaaataacagctattttatatggaaaatatgtggacaacagcgataaattgaagcttaaatctaaattggataaagcacttacacttcaaaaggagaagcagaagttacatttagagcagctcagtatgtcagaggaagatagggttatcaaagttgtttacgaattaatagatgataagctatatgaaaaatgcagttataaaaataaagcattatatagaggaaaagcagatgaaatgttggttagtaatagaggtgtgtttcttagtagaaaagcattagtttatggtctcaaaaagcataagtgtacaggtattagtgtaaataagattattttagcattatcgcagatggagcttttagatgaagaccggggaggaacgcatactacaaaagtacaaaatatacggacgtattgtattttatattatgagttgaaagaacggtatgaggaattaagaggcacaggggaataagaccattgtaggtaaaataaggagcggtaattatatattatccttctgaaagattcataggagactatataccttctgatatatggttacctatgaatctatcatttatcgaaatcaagtgtctgtatagcttaaaacgatacagtcataagacaactcatgatttcaatacgatgtataggaggtttttgtatgaatcagacaacaaagcgaagtaaagaattaaaagaagtccatgtaggcagaaatgaaacagggaagtctattacaggtatttctttagaagctccaaagtattcctgtatagaaacaaaacaggatggtataaaagttattttggagtttccagagtttgatgagacaagggaacggacagaggcaggataccatcaaatggagattcaaaaagaagtaaataatgtactgtctcatacattaagggagcagattaaaaatcatcagatttatcatgtagaaaggatttcctaagatgggcgagaaaaagagggtgcggatgttgcttcgtgtaagttctaatcaacagttggaggaagatggagacttaggtatccagagacagttggtgaaagaatttatcgcacaacatgaggaatggcatctggattcaaaggaatactttgagggaagtaatagtggatacagtaatgccgtagagaatcgtgatattttacagcaggcattgcgagatgcacaaagaaacgagtatgatattcttgcagtctataaggatgaccgaatcggtagaagaatgtgggaaattggtgcatatgttatgcagcttaaaagctatggtgtggatatatatacggtaaaagatggctgtatctcaccagagagtgatgatattatgggacagatgatgttagctctgcgttatggcaatgcacaaaagagcagttctgatacgggaatgcgtgtcaaagatacggcacaaaagctagtacagcaggggaagtttgtcggggggaaggctccgtatggatataaattggagctgtctggagaaatcagtaagcatggaagagcattacaccatcttgtgattattcccgaaagggcaaaggcagtaaaacatatatacgagctttctcttgataaagagtacggttcttcaaagattgccagagaactgaatctggatgaggaatataaagaacttgctccatctgaggtatggagaggtggaacggtaaccagcattttaacgaatccgatttatgcaggttatacggcttataaacgtagagaaaagaaagaaaacggaaaaagtaagcggttagatagttctgaatggattctctcggaagaaccaaatccagagatacagattattagtcctgatgactggaatctggttcagataaaaagaaagcagagagggatgaagtatcgtaccgctccgcagaataaaggtgtaaaggttatcgcaagaaatgaggggatgcttcccctcattgatgttatttactgtggatactgtggctgcaaatgtacaaatggaagtagatataactattggacaattaaagatacgggagaaaggagggcgagcagacaggcaatatataagtgccaggatgcatggcagggagttccacattacaaagtctatcaatttaaagcagaaagaattgaaaagattgtgtttcaggcgattgccgagtacatagataagcttcaggaaaacgaggatattttcgagcagatttccgagaatgggcgaaaggcaaaaaaggagaaagcgaaagaactttcaagagaacaggaaagactcaagcatatccagcaaaagatttctgtcatggaagataagattccagaagcgatgcttggagagtatcctgtacctgtagataagctggtagaactgattgaaaagcagaagcaggaaaaggaacagcaggaaaaagtgattgcagagaaacaaaaggaacttgacggagcggatgtctcttttaatgagtgggatagtctgcgtatgcagattccaacatggaaggatgtatttctgaatgccgacaatcctacaaagcgtgtccttgtgaataagcttattgaaaaaatatctgtaaaagaggatgaagttgtgataagatttaagataaatataaacgagatacggtcaaaagctttaaagaaatcaggaagtatagtgccggagaataagctggaagataagtccgttatcttagatagtctcaagatttatccaaaccccgaatgaacgatggtttcgacgtatcggggaaagggaaaagacttcaccatcacatcatccaccgcctttgaccaaaagtggattaacggcaaaaacacctatgattccatcagcaatgtagtagatgaaattttcaattcctacctttcaagaccagaagtgacacagccaatactcacacagtactgtgacggcaagcgggtaagctgtccggagtttatgagccagtggggttcgaaggcattaggggatgacgggctttctgcgattgagattttaagatactattatggggatgatatgtatattaatgaagcggagacgatttcaggaattccggcgtcatatccgggatatgagctgacaattggagcttcgggacaaaaagtgagacaaatgcaggaacagctcaatgtaattgcaggggactatccattgattcctaaaatcagggtggacggcatttatggaccggcaacggcaaattctgtaaagatttttcagaagattttccatttgccggaaacgggagttgtggactttgcaacgtggtataaaattagtcagatttatgtcgcagtaagtcgaattgcggagctgaaataatttcttgctgacagaaaattagttatcggaattatgcacaaagcaacatggtaataaggggggaatgggcggcgaaagatagaaattgtagtttttcgctgttcctctcttgtaattgcattcgatgtatgctagaatttgtacaatttaagtatttatgcaaagagcggcaacgtagatgtcagtttttttcgcaagtctgaaaagacacgttcccggccgatttgtttgataagcatagttttcgcacaatgagccgggggaacccgtctttttttttgcaaagaactgtaattaggagtgacttactccagtgctgtttttgcattttccttaatatgcagttgcaaatgattgaatatagaaaggaacgtgaatcatgaaggcatttctaatcttagaagacggaactgtgctgaccggcgaaagctttggagcagccagagaggtaatcagcgaggtagtttttaatacttccatgacaggatatctggagatattgacagacccatcctacgcaggacagtccgttgttatgacttacccattaattggtaattacggaatctgtatggaagacatggagtccattcatccgtggccaaaagctcttattgtaagagaatgtgccaaactggcaagtaacttccgtaacgagatgacattagatgaattcttaaagaaatatgatgttccgggaatttcaggaattgatactagacatctgacacgtatcttaagagagtacggtgttatgaacggaatgattacaacaagagaagatttcgacctggacgaagtagtaaagcagttaaaagaatataaagtacaaggtgttgttcgtgaagttagctgtaaggaaaagagagtgcttccaggagatggttttaaagttgccctcatggattttggagcaaagaagaatattgagaagtctttaaataagcgtggatgcgaagttacggtttaccctgcttacacaaaggcagaagagattatcgcagcaaatccagatggaatcatgctttcgaacggtcctggagatccaaaggaatgtgtggagattatcgaggagcttaagaagttatttgctacgaatattccaatttttggtatttgtcttggacatcagctcatggcacttgccaacggcgcagatacaaagaagatgaaatacggacatcgtggagccaaccacccggtaaaagatttaaaaacaggaaaggtttatatttcctcacagaaccatggatacatggtaatggaagattctctgaacagagatattgcagaagtaagctttattaatgtaaatgatggtacattagagggagttcactatcttggaaagaacgttatgacagtacagttccatccggaagcttgtcctgggccaaacgattccgaatttttatttgaagagtttatcaatatgatggaggttgcaaaagatgcctaagaataccagtattaaaaaagtccttgtaattggttccggtcctattgttatcggacaggctgcagagtttgactacgcgggaacacaggcatgtcgttccttaaaagaggaaggaattcatgttgtccttgttaactctaaccctgcaacaatcatgacagataaagatatcgcagatgaagtatacattgagccattaacaccagaagttattaagaagctcattttaaaagtttctccggacagtcttcttccaacattaggtggacaggcagcgttaaatatcgctatggagttagatgagtgtggtttcttaaaagagcacaaagtaaagcttatcggtacaacaggtaaaacaatccgtaaggctgaggacagagaagaatttaaagaaacgatggaaaagatcggtgagccaatcgcaccaagccagattgttacgaatgtagaagatggtctggaatatgcgcagaagattggatatccagttgttcttcgtccggcatacactcttggaggaagcggcggcggaatcgcagataatgaggaagaattcgtggaaatcatccagaacggtcttcgtttgagccgtgtaggccaggtattagtagagaagtccatcgcaggatggaaggaaatcgagtacgaagtaatgcgtgacggaaatggaacatgtattaccgtatgtaatatggagaaccttgacccggttggtgttcataccggtgacagtatcgtagttgctccttctcagactttaggagataaagagtaccagatgctccgtaattccgcattaaatatcattgacgaacttggtgtagaaggtggatgtaacgtacagtttgctttaaatccagatacatttgattattgtgtaatcgaggttaaccctcgtgtaagccgttcttctgcattagcttctaaggcaactggttatccgattgccaaagttactgcaaagattgcgcttggttaccacttagatgagattaagaatgccgtaacaggtaagacattcgcaagttttgagccagcacttgactattgtgtagtaaaggttccaagacttccatttgataagttcatttctgcctcccgccatctgacaacacagatgaaggcaactggtgaggtaatgagtatctgcactaactttgaaggtggtctcatgaaggctcttcgttctttagaacagcatgtagacagcctgatgcatggcgattttgacaagttaagcgacaaagaattagaagaacatcttcatattgtagatgaccttcgtatttactgtatcgcagaggcactccgccgtaaagtgaatccacagaagattcatgacattacaaaaattgatttatggttcatcgataagttaaataacatcgttgagatggaagcaaaacttaagaacgcagaagaattagaccgagaccttttacttaaagcaaaagaaatggaattccctgataaagttatcggagagcttatcggtcagagtgaagaatatgtaaagaacttaagaagacagatggatatcgttcctgcctacaaagttgttgatacttgtgcggctgagtttgcggcagaaacaccatattattactcttgttttggaagctttaatgaagtagaagaaacttctgataagaagaagattatggtactgggttctggtccgatccgtatcggacagggtattgagtttgactactgttctgtacacagtgtatgggcatttaaagaaatgggttacgagacgattatcgtaaataataaccctgaaacagtaagtactgacttcgatatcgcagataaactttacttcgagcctttaacagaggaagatgtagaacatatcgtagaattagagaaaccggacggagcagttgtacagtttggtggacagacagctattaagttaacagaaaagttaaataaaatcggtgttccaattcttggtacaagtgctgagaacgtagatgcagccgaagacagagaactttttgatgagattcttgagcagtgctgtatcccaagaccaaagggaggtactgtatttacaaaagaagaggcaatcaagacagccaacgagattggttatccagtattaatccgtccttcctacgtacttggtggacagggtatgcagattgctatttcagatgaggatatttcagaatttatggatgttatccagagatatgcacaggaacatccaatccttatcgataaatacctgatgggtgttgaggtagaggttgatgccgtatgtgatggtgaagaaatcgttatcccgggtatcatgcagcatgtagagagagccggaatccattctggagacagtatttccgtatatcctgcaagagacctttctcctaagattaaaaaggttatcggacattatacaaagttactggcaaaggctttacacgttatcggtcttatcaatatccagttcattgtatatcaggatgaagtatatgtcattgaggttaaccctcgttcttcaagaaccgttccttatatcagtaaggtaacaggtattcctatcgttgaccttgcaacaaaggttatgacaggaatgaagttaaaagacttaggttacgagccaggacttcagccagaatctccatactgggcaatcaagatgccagtattctcattcgagaagattcgtggtgcggatatcagccttggaccagaaatgaagtctacaggtgagtgtctcggtatttccaagaactttgaggaagcgttatttaaagcattcttaggttctggtgtagatttaccaaagcataagaagatgatcatgactgtaaaggattctgataagttagatgcagtagaagttggtaagagatttacagcacttggctacgaaatctatgcgacaagaaatacatgcaagacattacaggaaagcggtgtgccggcgaagagagtcaataagattgaggagtcacatccaaacctgctggatttaattttaggacatcagattgatcttatcatcgatacaccttcacagggtattgaaagaagcaaagatggttttgttatccgtcgtcatgcggtagaaacaggtgtgaactgtctgacttctcttgatacagcaaacgccttacttaccagcttagagtcttcctgccgagaagatttatctttagtggatatcgcagaaattgataaagagattgagagcaagattaacgaggcataaaaagggaagtgaatccctgatataaataaatatgtactcatggagtcttttatgcatttacccttgcaaaagatttcatgggtacatagcataattgggaggataccaatgggaaattatacaaagcaggatattattcagcttgtggaagaaaaagatgtacagtttataagacttcagtttacagatgtatctggtaccttaaagaatgtggcaatcacagccagccagcttgaaaaagcattagataataagtgtatgtttgatggctcatctattgagggatttgtccgcattgaggaatccgatatgtacttatatccagatcttaatacatttgagattcttccgtggcgtccacagcatggcaaagttgcccgtttcatgtgcgatgtatatcgaccagagggcgtgcctttcgagggagacagccgttatgtattgaaaaaagtattaaaaaaagcggcaaagatgggatatacttttgatgtaggaccagaatgtgaattcttccttttccatacggatgataatggacagccgacaaatatcacacatgaaaaggcaagttattttgatgttactccattagatttaggagagaatgcacgaagagatatcgttcttacattagagagtatgggcttcgagattgaggcttctcatcatgaagtagctccggcacagcatgagattgactttaagtatgataatgcattagtaacagcagataatatcatgacatttaagatggttgtaaagaccattgcaaaaagacatggattgtatgcgacctttatgccaaagccaattacagatgtagacggttctggaatgcatatcaatatgtcccttgaaaaagatggaaagaacattttctttgataagagcaatccgatgggactgagcaaagaatgttatcatttcattgcaggtcttattaagcatgctaaaggtatgtcctgtatttgtaatcctcttgtaaactcctacaaaagactggttccgggttatgaagcaccggtagcaatctgctggtcttccattaaccgaagtccattaatccgtattccggcatcgagaggtgcaggaacaagaatcgaattcagaagtcctgacccggcagcaaacccatatcttgttatggcactttgtcttgcagcaggtcttgatggaattgagaatgaattagaagcgccagaaccaatcggtaaaaatatgtatttacttacagaagaacagattgctgatatgaatattgatgtccttccggcaacacttggagaagcctgtgatgcctttgaagaggataaatatattcaggaagttttgggagagcatatcagtaaaaaatatttggaagcaaagagaaaagaatggcatgaatattgcagacaggtttctgattgggaaacagaagcatatctttataaatactaacagctcagctgcctaaaatatcgactgtagattgaaaaactggaatccttatgagggtgagtggaaagtgctgaatattgttgttgtgtttccgaaaaaggaaattgtactaaaaatgaaaaatgttctaataaagaatggctttgatgtgtcagctgtctgtgttaccggagcacaggcgattcaggcagtggaaagactggaagcgggtgttgttgtctgcggcatccgctttgctgatatgatatatgatgaattaaaagagtgtattccagatacttttgagatggtcgttattgccagcaatgcccagtggcaggaatatggagatgatgatgtcatttatctgccattgccgttaaaagcatatgatctggtagataccgtatcggatctgctgacagatatacatagaagattaaagcgggaaagggaaaagccgaataagagatcttctgctgatcagggagttattaatcaggcaaagtctttattaatggagaaaaatgaattgacagaagaagaggcgcaccgttaccttcagaagagaagtatggataatggaacgaatatggtagaaacggcctatatggttttgcaggttttttgatccggcatttttgaaactgtatagaatgaaagtagatttttgcgctttttaataagttgttttggaaatctttgcttaatttcataagtaaaacacactttataaatgaaatcttgcaggtgaaatctaaataattgtaagaattttattgaaaaatgaggataactcttgttaaataacgaagattatcgtatattttaagttgcttatatgtgcaaaagaagggagcagcctatgaagtttacaaagatgcatggaataggaaatgattacgtttatgtaaattgtttcgaagaatcaataaagaatcctgcagaagtatcaaagtttgtcagtgaccgtcattttggaatcggttcagatggattaattcttatcagtccgtctgcaaaagcagattttcgtatgaatatctataatgcagatggttctcaggcagaaatgtgcggaaacggtatccgttgtgtggcaaaatatgtgtatgattatggtctgacagataagacagagatttctgtcgaaactttagcgggaatcaaatatttaaaacttcaggtggaaaatggcaaagtagcaaccgtagaagtaaatatgggtgcaccaatccttgaaccaaagaaaattccagttgcagtagagaataatccagtagtggatgtccctgttgaagtaaagggaaaaacttaccatatgacatgcgtatctatggggaatcctcatgcgattatctttatggataacgtaaaggaattagatatcgaagctattgggccatatttcgaaaatcatccggtatttccgaaaagaacaaacacagagtttgtggaagtgttagacaaaaacacagtaaatatgagagtatgggagcgcggcagtgatgagacactcgcctgtggaacaggtgcctgtgcaactaccgttgcctgtatattaaataacaagacagaagacgaagttacagtacacttacttggaggagatttaaaaattcgctgggaccgcaaagaaaacttagtttatatgaccggtccggcaaccgttgtatttgatggggaaattactcttccggaaggaatactgtaatagacagcagtaggcgaaagccagttaggagcagctatgtttaaagtaaacgagaattatttaaaactgccaggaagctatcttttttctaatattgggaaaaaagtagcagcatacaaagaggcaaatccagacaaatctattatcagtttaggaattggtgacgtaacacagccattagcaccagagatcatcaaaagtcttcacagtgcagtagatgaaatgggaaaagcagaaactttccgcggatatgcaccagaccttggatatgaattcttaagaaatgcaatcgtagatggtgactacaagagccgtggatgtgatatcagtgccgatgaaatctttgtcagcgatggtgcaaaatgtgattccggaaacattcaggaaattttcagtgtagataacaaaattgctgtatgtgaccctgtatacccagtttatgttgacacaaatgttatggcaggaagaacaggaacatataatccgacaacagaaacatggagcgatgtaatctacatgccatgtacagcagagaacgatttcgtaccagacttcccaaaagaagaaccagatatcatttatctttgcttcccaaataatccaacaggaacgacaatcacaaaagcacagcttcaggaatgggttgactatgcaaacaaaatcggtgcagtaatcatctatgatgccgcttatgaagcatatatcagcgaagatgatgtagcacatagcatctacgaatgtgaaggagcaagaacttgtgcaatcgagcttcgaagcttctccaaaaatgcaggattcacaggaacaagacttggtttcaccgttgtccctaaagacttaaaagcaggagacgttgctttacattccttatgggcaagacgtcacggaacaaagtataatggtgctccatatatcatccagagagccggcgaagcttgctacagcgaagctggaaaagcacagttaaaagagcaggttgcgttctacatgaacaatgccaaaatcatcaaagaaggcttaaaagacgcgggatatactgtatttggcggagtaaacgcaccatacatctggttgcagactccagacaaaatgccatcctgggatttctttgacttcttattaaataaagcaaacgtagtaggaacaccaggttcaggatttggaccaagcggagagggatacttccgactcacagcatttggctcctatgagaatacattagaagctatcgagagaattaaggctctctaaattctggtttgcgtagcaaaacaaacagacggcgctacagaagcatagcaatcggattgccagaagaattattaagaagaagccctaaaaaatttattgattttgttccgttgtgctaaacgctccattttgcccaataaagcagaaacttcgcaaaaacgaatgcgaagtttctatggtcaaaattccgcagcacaaagtcacaaaattcaataaattttttagggcttctttttcatattttttgagcaatccgatagaatatctacagaggctgtctatttctaatccgcaaatcttttaaaacataaattctgactttactgagagcgtctcctttgctgcgcaaatcagaattgttttcttctcgctgtcgtgttattatggacaagacaattatgaagaatttatacaggagatgattacaatggaattttgggatatttatgatgagaataaacagttaactggacgaatgatgaagcgcaatgactggtgcttaaaagatggagagtaccatctgaccgttcttggtgttatcgcaagaccagatggaacttttttaattacaaaacgtgttatgacaaaagcatgggcacctggctggtgggaagtttccggtggcggtgtgcaggctggagagtcttctgaagaagcggtacaaagagaagtgaaggaagagacgggtcttgatgtgcgtaatgcggaaggcggatatttgtttacttataagagagagaatcctggtgagggagataactattttgtagatgtatatcgctttgtaatggatattgatgagaatgatgtatcatttcaggaagcagagattgatggatatatgtttgcaacaaaggagcagattgaaggatttgctgcggaaggtaagtttcttcattatgatagtattaagcaggcattttcgtttgaaaaataatgttgtagagtgcatttgaaaaaacaaaaggcgaatttttttgagacattttatagaattttttgttatagaaaaatagcgtgtttttagattttgttgagaaaacgatttgtcatattaagaattttataaagatatcctgttaatgatatttatgtaaaaatataattaaaagttactttgtaaagcagcgtataattagcgtaaaaatgaagagatatctttgtaattaaggcaaaaagacttgattttacggatgcattatagtagaatggcaaacggttttaagattgatttaagattagattcaggaaaggaagtgaaatacatggacagttgtgatagtgcggggcgaagtatgatttgcggtggcagtaagaagattttgacatggctgaacgtggatttcatttttagctgtgcctgattttggatgtctctatatgatattttttaaatatttcttttttctccaccgcgtggatggattcctgtacagttcgcacacaaattcagtatgtgagagaatcgcatacagtgaatagctggctgatgaactgccgaatggtttttgaatcggtgtacctgtagtagtgatatttttgaataacttattttctttttatgaaaattatgttgttggctataaggcgagagacagtacacagaaagcggtggactttttatgccctttttggggaagaaaggagagatatgatggagaaaatgttaaagaaaccggattatgcaaaagagattcttgcgattatgcatggctctttttcaaaagaggaaatgcttgaccgaattgctgattaccatgaaaatgatattgcagaggcttttgagcttctgtcagagtccgagagaaaaagctggtaccagatgtttgggcctgaacagattgcggagattttttcgtatattgatgacccggattcttatttgaaggaactgcctttagatgaggctgcaaaagtgctttcttttatggattccgatgatgcggttgatattttagatgagatggatcattccacgcaggaaaaactggtcggattgctcgatgaggaatcgggacatgacattaagatgattctctcttacgaggatgatgagatgggtagcaaaatgactaccaatttcattgtgattcataataatctgacgattcgccaggcgatgcgtgaattagtacagcaggcaggggaaaacgataacatttccacagtgtatgttttagatgaaaatgataaattttatggtgcgattgatttaaaagatttaatcgtggcaagacaggaagacaatttagaagacattatcagtacctcttatccttatgtaaatgaccacgaaatgatagatgattgtattgagagaatcaaggattacgcagaggattctatcccggttctgacagaagataatttattaatcggtgttatcacagcaatggatatcattgaggccgttgatgaagaaatgggagaagactatgcaaagttagccggtcttactgcagaagaagatttaaaagaaacaacaattgaaagtatgaaaaaacgacttccgtggttgattattctcttattcctcggaatgggagtttcctctgttgtcggtgtctttgagactgttgttgccgtacttcctgttgttatgtgttttcagtcattaatccttgacatggcaggaaatgtcggaacccagtcattagctgtaacgatccgtgtattaatggacgagacattaagcacaaaacagaaacttggtcttgtagtaaaagaaatgagaatcggtttatgcaatggccttttccttggcgttttagcatttgtatttatcggattctatatctggctgctcaagcataatccagttgcacatgcctttgtaatttccggttgcgttggattctcacttatgacagcaatggtcatttcaagcatggtaggaaccctcgtgccaatgttttttcacaaaattaagattgatccagcagttgcatcaggtccactgattacgacaatcaatgacttggttgctgttgttacctattatggattagcatggctgttgctgattcatgtactgcatatggtttgatttattaaaaagacagacgaacgagacgaaccccaaaagacaatatcccccatatctgtggcctcggagctgcgaggtcacagatatgggggatattgtcttttggggttctaagtttgcgtctgctatagctttgaattttaatcattttgtaagttgtaaaatacaggaaggtaatgtatactaaagtttgttcgaaaatgaaggaatctgtttcatctgctttttatatgggaactttaaaaatgcagggggatttacgaaagcattatgcgaaacatcggaagaaaggaagcgcgtagcaggtgaaggatgacgagatgaaaagatatttaaaaataggaattatcggagcggcgatattggcatcggggattttatgtgcatttgtattatttaaaatgccagttattatttccgttttaaaggggattactgagattttgaaaccatttttatatggagtggtattcgcatatcttctggctcctttgtgtaataaaatagaagaaaaactatttcagattttcccgaaagcaaagacaaaagcaagaagatttatctgttttatagcaatcgtaatatcattatgcgtagcaattgcggttatatggctcattatcatgatgattattccgcaggtatgggatagtgttatgaagattatccagatggtgccgcagaaacttattgtagtaaataactggattgaacatatgcttgaaaatcagccagaattacaggcatattttgaagaattttcaagtcaggcagaaagcaatatcgacagtcttttaaatgtagacacgatacagaaagtgcagagtattatcaacagcctcagcgtacagttatttggagtacttggcgttgttaaaaatattttcctgggattattgatttcggcctatcttcttggaagcagaaagctttttggggcgcaggctggactcattttacacggagtattttctgacaagtgggcaaaaattattgaggaagaaatccgctacacagacaaaatgttcaatggatttttagtaggaaaaattattgattctgcaatcatcggacttttatgttttgcaggaacatccattatgggatttgaggcaccggcatttatcagtgtgatcatcggaattacaaacattattccgttttttggtccatttatcggagcaattccatgcggtttattacttcttttggaaaatccaatgcattgtctttactttattatttttattttcgtattgcagcagcttgatggtaatgttatcggaccgaagattcttggaaatacaactggtgtctcaagtttctgggtattatttgccattttattatttggcggaatgtggggagttgtcggtatggttatcggagttccactgtttgcggttatttatgacatcataaggaaactggtttaccgcggacttcgcaaacataagagagaatccatgataacggattacgaggaaaaatatcataaatcctgattgccgcaggcaaagagacgcgctcggagaatgaaataacctatatttgtggcctcgtatccaaaccttgctccgagaccacaaatataggttatttcattctctgagagctgactgtggatgctggcacaaaatcagaaattgcatttttatttccgagggtgtataaataacctatactatgcgatttgaattaggaggtagtggtatgacatatgaagaggtaatgaaaaaagcaaaatcagagattggaccatactgtaaagtttgtccacagtgtaacggaaaagcctgcaaaaaccagatgccaggcccaggtgctaaaggggtaggcgacgttgctataagaaactatgacgcatggaaagatatccgaattaatatggatactatttgcgagaatgtaacaccagatacaagcattgagttgtttggagagaagtttgattatccattttttgcaggacctgttggagcaatgaagcttcactacggggataaatatgatgatttgacctataatgatattttagtttctgcctgtgcagcaaatggaattgcagcatttacaggagatggtacaaatccagatgtatttaaggcagcaacggcagcgattaagaagaatcacggacaggggatcccaacagttaagccttggaatatcgagacaatccgtgaaaagatggatatggtgcaggattgtggagcgaaaatggttgccatggatattgatgcagcaggacttccatttcttaagaatcttaatccaccggcaggaagtaagacagtagagcagcttggtgagattgtcaatgcggcaggaattccgttcattgtaaaagggattatgacagtagcaggagcaaaaaaagcatttgatgccggagcaagtgcaatcgtagtatctaatcatggtggaagagttcttgaccagacaccagcaactgcagaagtattggagagaatcgtagagtggaatcagggacgtatgaagatatttgttgatggcggtatccgtcagggaaccgacattttcaaagcattagcaatgggagctgatgccgtacttattgcccgtccatttgtacaggcagtttacggcggcgcagaagaaggtgtcaaactatacatcgaaaaacttgccgcagaactttctgacacaatggcaatgtgcggagccgcatccattaaagacatcagccgcagtatgctgtatcgtccaatgtagatatagttaaataagatttttgatttcgggcaaatgacatatgtggtttgtccgaaactacagtgtgcgcagatatttttgatttctcaagcacactctggaaatagaatatatatatatatctgaagtttataataataaactaacgaattgagttatgattagatgcgaacatataaaaagatatattaagaggataaggaatacaaaacatgaataaaaaagacaccgtagtatttgaccttgatggaaccttacttgatacattagaagatttaaaaaacagtgtgaattatgcaatgacacagtgtggctatccagagcatactttagatgaagtgcgaagatatgtaggaaatgggattcttttgctaatgcagagagccattccaggaggaaaagacgatccaaactttgataaggcatttactttgttcaaagaacattatggaaagcactgtaacgatacaacaaagtcttatgctggcattatggagttacttcacactttaaaagaaaataatatcaagattgcaattgtttccaataaggcagactttgcagtaaaagaattaaatgcaatctattttaaagatttaattcctgttgcaattggagaaaaagaaagcgaaggaatccgaaaaaagccagcaccagatacggtaatcgaagcattgaaacagctcggaagcactgcagaaaactccgtttatatcggagactccgatgtggatattgaaacagcaagaaacagcggcatggatgaaattctatgcgactggggcttccggggtgaagaattcttaaaacaacacggagccaaaatcataatcaaaaagccggatgaaattctatccctcatagggattgagtagcacccctcctcagggaaacagacgaccccagaatcctaagaaactatatttgtgactttcgtcgcagcggtttgaatgttcgcttatgcgctcgcattcaaaccttgctcccaggtcacaaatatagattatttaggattctggggtctgtttatataatgtacccataatttggatgaatgatttttgtttcaattccaaaactaaaattattgaaatgttgtcacaatcttcaacattaaaatatctgcgattatccttaattttcgagtatttgcacatattgcaacaacacagcggagtagaagccttgggatggcaacgactcgaaaattaaggataatcgcagatattttaatttcagaacccctggcaacatttcaataacagctcacttggattattgaaacaaaaatcatcacaaaaatctccctacatttaccatcatattttctccctatttgcacacaataggattacggtattcaaatcgaagattcattacggaggtagagacaatggcaagtaataaaaattcttcatctaacagagtagaagtaccggaagcaagagacgcaatggaccgttttaaaatggaagtagccaacgaacttggtgtgaatttaaaacagggatataacggagatattactgcaagagatgccggctccatcggaggagaaatggttcgtaagatgatcaagagacaggaagaggaaatggctggtcagagccgctaaattttcgctggttctttagaagagtcccttactgaaatcagaataccgtaagaatgagctgtctgcccttgaaaatgaggacagacggcttattttgatgttttttcggtggttttctgcaagttttctatcagtttttcgtcaaatagttatagacagtgaatatttctcatgctataatgtttaaatgtgttttcatataattaaaatacaaaatgagtttactatgaataaactttaaataaggaacatattaaggaggatactaaaaatgagcgtacaggttgaaaaattagagcataatatggccaagcttactatcgaggtagaggcatctaaatttgatgcagcaatgaagaaggcttataataagaagaaaggctcttttaatctgccaggtttccgtaaaggaaaagtacctatgtatatcattgagaaagaatatggcgcaggagttttctacgaagatgcagctaacgaacttatgccagaagcttatgcagcagcattagaagagagcggtcttgaagtagtttcccgtccggaagtagacgtaactcagattggaaaaggacagaacttcatctttacagcagaagtagctgtaaaaccagaagtgaaattaggagaatataaaggcttagacgtacagatggattctgtagaagtagctgatgaagaagtagaagctaaattaaaagaggctcaggaacagaatgccagagaaatcactgtagaagacagagctgtacaggatggagatatcattactcttaactatgcaggtactgttgatggtgttgcatttgacggtggtacagcagagaaccagcagttagtaatcggttcccacacatttatcgataatttcgaagagcagttaatcggcgttgaaatcggtggagaaaaagacgtagaggttactttcccagaagaataccatgcaccagatttagctggtaaggctgcagtattccatgtagaagttcttggaatcaaggaaaaacagctcccagaaatcgatgacgatttcgcacaggatacaacagagttcgatactcttgaagagtacaagaacgatatcaaagaaaaacttgctacagcaaaagaagagcaggctaaatctgccgcagagaacgctcttatcgagcagatcgtagagtcttctgagatggatatcccagatgctatggttgacttccaggtagaccagatggtagatgagttcaaacagagactttcttaccagggactttctcttgaacagtatgttcagttctccggacagaacatggatgctttaagagaaaacatgaagggcgacgcattaaagagagtacagggaagccttgttcttgaagcaattgttgcagcagagaatattgaagcaaacgaagaagacttaaagaaagaatttgaaaagatggctcagatgtatcagatggaagcaagtcagatcgaaggcatgattccagaagaacagaaagagaacatgaagaaagatatcgcagtccagaaagcagttgaatttgtactgaatcaggcaaatgtaacagaagctactgaagagcttgattttgaagaaaaataggagtaacttaaagatagttacacataattaaaatttctggttgctgtttatgtagaaacaggaggaattatgagtttagtaccttatgtcattgaacagacaagtcatggggagagatcttatgacatctattcccgtcttttaaaagagagaattatttttcttggtgaagaagtgaacgataccacagcgagcttaatcgtatctcagctccttttcttagagtctgaagaccctgagaaggatatcagcttatacattatgagtccgggtggttctgtgactgctggaatggcgatttatgacaccatgcagtttgtaaagtgcgacgtatccacaatttgtatgggtatggcagccagtatgggagcattccttctggccggcggcgcaaaaggaaaacgtctggctcttccaaattctgagattatgattcaccagccatccggcggtgctcagggacaggctacagagattgagattgtggcagaacacattctgcatacaaaagaaaaattaaacagaattcttgcagagaatactggtcagccatacgagaaaatcgttcaggatacggaaagagataactatatgacagccgagcaggcaaaagcatatggtcttattgatgccgtggttgagaaaagacagtaagatgtatttttgaaatctcagtatatctgcttctagtgcgtgtttggaaaatgctttcataaagatgcgtgttatataaacgttttagggcgggctgaaagatttcggaaatacatgaaataatagggttaccacagctatcaattatagttgtggtaacttttctatgagacagattgcaagcaggagtgaggtgacaatatggcaacacgatccgacaacaacaagcaattcagatgttcattttgtaataaaacgcaggatcaggtaagaaagctcgtagctggtccaaagggcgtttatatctgtgacgaatgtattgaagtatgcacagaaatcatggaagacgagtttgaaaattttaatgaagacacacaggaaatcaatctgatgaagccaaaagaaatgaaggctttcttagatgattacgttatcggtcaggatgaggcgaaaaaggttttatccgtagcagtatataaccattataagcgtatactggcaggtggaagctatgatgtagaacttcagaagagtaacatcatcatgcttggacctactggttctggtaagacacttcttgcacagacattagcaagacagttaaatgtaccatttgccattgcagatgcgacagcattgacagaagcaggttatgtaggagaagacgtagagaatatcttactgaagctgattcaggcggcagattacgatatcgagcgtgcacagactggtatcatttacattgatgagattgataagattacaagaaagtcagagaatacttctatcacaagagatgtttctggtgagggagtacagcaggctttattaaagattttagagggaactgtagcttctgttccgccacagggtggaagaaagcatccgcatcaggaattccttcagattgacacgacaaatattttatttatttgtggtggagcctttgatggccttgaaaagattattgagaaccgtattggaaagaaatctatcggtttccaggcagagattatggaacagcgaaagaaggacgtaggtgttttattaaaacaggttcttccagaagactttgtaaagtttggattaattccagaattcattggccgtgttcctgtcaatgtatctctgaatccattagacaaagatgctctcgtaaagattcttacagagccaaagagcgcattagtaaaacagtaccagaagttatttgagatggatggtgtagagcttaagtttactgatgatgccttagaagcaatcgcagaaaaggcaattgcgagaaatacaggagccagaggacttcgttctatcatggaatctgtagtaatggatttaatgtacacgattccatcggatgatttagtagaatcctgtacaattacaaaagagacagtggatggaagcggtgagccggagctgacttatcatgaccagccagtaaccaaaaagacggttacaagaaagcgtcaaaagaaaaataacaacgaaatcgcttaacatgtactgttaagaggcacaggctgacacaggagggagttttttgttacctttgtgccagcctttttatataatagtacgattttcatataaataatgtagactgctttttgtcaataaaatggttaaatgagacaatagacagtattgctcgctgaagataacatagtttgatgaaaagctaattatttagaaaaatatcattaagatagtatattactaatttattataaaaaataaacataaaaatactccgaaaaaggaggaacaaatggagaaacaaatattacctttgcttgcattgcggggcaagatggtttacccaaatacttctgtgtattttgaagtatcaaggccaaagtcaatggcagctttagaacaggcggtaaatcatgaacaacggatttttctggtgaatcagattgacccatctttagataagccggaggaagaggatttatatactgtaggaacagttgcgaagattcttcagatggtaaaagccggacagggcgtattgagagtatttgtagagggtgaggcaagagccagaatcacatcttatatagaatttgatggatgtgtgaaggcagaagtcgaagagattcctgatacaaattacccggaaaatccagtggaagaggaagcattttttagaatgttagaagaggaagcgcaagaattttccgagaagaatccgggattttttgcaccacagcttcaaaaagccattgatgaaaaagaattacttctactgattaacgaactggcatcccagcttccatttgaacttggaaagaagcagcagattttagaagagtctgatgtgaaaaaacaggtagagatgctccttgccattttgaaagaagaagtggaaatcagtatcatccgtaatgaacttgcagaaaaagtaaagaaaaatgtagataaaaaccagaaagattatcttttaagagagcagcagaaggtaatcagagaggaacttggcgaggatgacattgtctcagaagcagacgaatacctcgaaaaatgtgaggcattaaaagcctctaaagaagtaaaagataaaatcaaaaaagaaatcaagcgttacaaaaagatgcctcctgttgcggcagagagtacaatgacgaagaactacatcgagacaatgcttgaaatgccgtggaacaaggtttcaagagatagcaagagccttgaaaaagcaatggaaatcttagaggaagatcattacggacttaaaaaagtcaaagaacgaatccttgactatcttgctgttcgtttccttacgaaaaagggagagacaccgattctttgtctcgtaggtcctccgggaacgggaaaaacttcgattgcaaagtccatagccagagcacttcataagaagtatgttcgtatttctttaggtggtgtgcgagatgaggcagaaatccgtggacacagaaagacatatgtcggagcaatgccaggaagaattgctgagggaatccgtcaggcaggtgtaaagaatcccctcatgcttttggatgaagtagacaaggtaagcagcgattataaaggagatacagcatctgcacttcttgaagtgttagatggagagcagaatgtaaacttccgtgatcactatcttgaagtacctttagatttaagcgaagtattctttatcgcaacagctaatgaccttacaccaattccaaaacctttgcgtgaccgtatggaaatcatcgagctttccagttacacagagaatgaaaagttccacatcgcagaaaattatcttgtaaagaagcagagaaagttaagcggacttacaaaaaaacaggtaagcatttctgatgaagttatccgtgaggttattcatttttatacaagagaagccggagtacgtaatcttgagcgtactattggacagcttatgcacaaagccgcccgcaaaatcgttgaaggtgaagaaaaggtcgatattaagaaaaagtctttaaaagaacttcttgggccagcgccatttgaggatgaagatgagaacttaaaaccgcagattggtgttgtgagaggacttgcatggaccagtgttggtggagatacgctttccattgaagtaaatgtcatgccaggaaaaggaaagatggagcttaccggatgtatgggcgatgtcatgaaagagtctgcacagattggtcttagttatgtccgctctattgctgaaaactatggaattgacagcggttattttgaaaaacatgatattcatctgcatattccagaaggagccgtaccaaaagacggtccatctgcaggaatcacaatggcacttgccatcctttctgcaattacaggcatcccagttcgaggggatattgctatgacaggagaaatcactcttcgaggaaaagttcttccaatcggcggcttaaaagaaaaactcttagcagctaaaaccgttggtgtaaaagaagtccttgttccagcaagaaataaacgaaacgttgtagaacttgatgaagaaattacagatggcatgaagattacttatgttgaggatatgaatgaagtgattgaacatgctatgaaaaagtaactacgatgtttgaataattaagtcattgatttctatcaaagataatagctaaataatcaatacatattaaaatttatgatttagattaactgatatatatatattgaaccatggtttaaaaagttagagaaaggaggaaaaacatggttataaaaaatgtaaacttagaaactgtatgcggaattacaagtaagcttcctaaaaacacattaccagaagttgcatttgccggtaaatcaaacgtagggaaatcatccctcattaatgcccttgtaaacagaaagtctttagcaagaacttcaggacagccaggaaaaacacagaccattaacttctacaacgtaaatgaagaaatgtatattgtagaccttccaggatatggttatgccaaagtatctaaagaagtcgcagcaaaatggggaccgatgatagaaaactatcttcatacttctgaacagcttcgtatggtattcttactcattgaccttcgccataagccaaccaataatgatgtacagatgtaccgctggatcttaagcaacggtttctctccggtaattgtagcaaccaaagccgataaaatcaaacgaagccagcttcaaaaacagttaaaactgttaaaagatactttaaaagtaatcgaaggtgttccaatcgtaccattttctgctgtcacaaaagcaggaagagatgaaatctgggaactgatcgaggaatatgcattagctgaagaataaacaaacggacgaaccccaagagagaatagaacctatatctgtggctggataaagtttgtctgttttagttgacgaagacatagatgggttctatactatggtatggttttgtccgagttgtcactgcctgcggcaactcggtattttcaaaaccctgattaattgatataatagaagcggttttttacaaaaatttatgaggtgataaacatgcggataaaatcagtagcagttctcggagccggagcagtaggctcatatattatctggggactttcaaatcgtaaggatattaagcttggcgtaattgcggagggagagagaaaagaacgtcttgagaaaaatggatgtttgattaatgaaaaagtgtatcatccagaagtgtggactccaagcgaagctaatggagttgaccttttgattgtttctctgaagtatggagctttaccgggggctgttgacagtattaaagaagcagttggagataatacaattatcatgagccttatgaacggagtagacagtgaagagattatatctgagaaagtagatgcatctcatattttgcactcgattattaaggtagcttctcataaagaaggaacaggttattgttttgatccggagactacgattggaataatcttcggagagatttctgcgccatttgagagtgagagagtagaggagattaaggagctttttgcagatacaggcttacattttcgtgcgacagaatatattcgtgaggagatgtggagtaaatatcgcttaaatatctgtaataatcttccgcaggcgattcttggagcgggagttggctgttatagcgacagtacacatatgaaggcaatcagtgacggacttaagaaggaagtcgaggctgttgcagcggcaaaaggaattgatatgagcaaggtagatataaagtccgcccggggaagtgcggttcctccaacagcacgttattctacattgcaggatattgatgccggacgtcatacggagatagatatgttttccggagcgttagtgcgaatgggaaaagaacttggcgttccaacaccatataatgaatatacatatcatatgataaaggcattggaggagaagaatgatgggctttttgattatgatgggaaaaatgcagaaacgacctgcgcgaaataacttctgatttgtagaatttgaaaaataaacagacgaaccctcctcctctgtaatctataaaaatgcttcgtttcactgcgtccaagctgctcatccgcaacttgaacttgctctaaggcgcatttttatagattacagaggaggagggttctgtgtatttcagtcctacaaatcagttgaaaaaaatttggggatggggacagaagaaatagtctctctttgggagcgtctcctttgcctgcggcaaatcagaaattaattttctggggtgggagaatattttcagtgtattagtacatacttagtatactatatgaaaattttgaaggagagtgaaatgtatgaaaaaagaatttagtaatcaggaatacgcagagaaggtaaaaaagctgacccctaaattcagctcattttcaaactgctggcatgcgtttgtatctggaggagcgatatgtgttttgggagagttgatccgtcagatcgcgtataatagagttggtgtgagtgaggaaaattcatacattgtagtaagcgtttgccttgtattgatcagtgttgtgttgacgggttttcagctttatgaacctttggcaaagtggtgtggtgcgggaactctcgttccaattactggttttgcaaattctgttgcatcaccagcaattgaatatcaaaaagagggacaggtttttggaattggagtgaaaatttttacgatagcaggtccggttattttatatggagtatttacaagctgggtaattggatgtgtttattggatattttttttatagtatgttgcatatagtagatggttataaattattgttatggaaaaatcacttcaaaagttgtgccggagttcgcattatttttaactaaaatgctgccgttatgcacccttacaatctcacggacaagtgcaagaccgagtcccacgccgccaagttcccggcttctggatttatccagacggaaaaaaggttcaaatatccgttctttaagttcttcggggataccgtttccagtatcttcaactgtaagatgaagctgactgttttgctgtgtggcgtttactgtgactgttccaccggaaaagttatattttatggcattttcgacaagattatatacaagtcgatagatgagaatatcacttcccattaagagtacattgtcgcatttttcgataaggttgattcctttttcctgtgcaagaggttctaaatcagcaagaacctcttcaacaagagcagatattgcgatttcttcatctcgtgctattgtttgaagctcgctcatatcaagaagcgttcttaccattttgctgagccgttctgtttgttcggtaatcatgcttatagtttgttgtgcagatgtatcattattcggatgctttgaggaattgtacaaatctatctgaagctgcatcacagcaagcggtgtacgaagctcatgggcagcattagcggtaaattgcctttgcagcttaaatgcttctgacagtcgttcaagcattttattgtatgaaacactaagctggttcagttcagagaatttattttcttctattcgggaatccgacaggttttgtgcctgcacttcttcaattttctttgagaaatcacatagtggttttagtgcatggccacttataaaaaatgtaatcacacctccaagaagagataacagtgttgaaaatagcagactgctttttttgtagtcagctttattattatatacctgaatggaaaaattctttgcaaaattgttccactcttcatctggaatactgatatagatttcatctggattcttctcattattatcttcgcttttagcatctacagtattttgcagagaatcgatatagtagactccgtttttgtagataaatatagtaaggcttccgcatatcattgcgattagtaaagtagttataatagtgagtctccactgaagcgacatttttttcatgacacaccctccacaagcttataaccttcgccaatcttgtttacgatgggatcataaccgagcactgatttaaattttttcctgagagatgacatgtgtacccggatagagccgctaaaactgtctatggaagcatcccaaacatgttcaatcagttcttcctgacttacaggcctgccttgattaagaagtaaatattctaaaataccattttcctttctggttaaaggtacgagtattcctttggcatatgcttcccgctttttcgtatcaaactttatgtctttgcaatgcaagcatatatctttttgtacaaatttacgtcttgtaagacttcggatacgggcttctagttcttgtatatgaaaaggtttttccatgtaatcattagctccggcatctaatccttccaccttatctataatctgacttcgtgcggataagataagaaccttcgtttcttcgttttcttttcttagttctcttagaatatccattccgtccatgccgggaagattaagatcaagcacaattagatcatagtcttccgtcaaaatataatcaagagcctcatatccatcataacaggtatctacttcatagcctgattcgtacaagctttttgaaatggtatcacataattctttttcatcttcaacaattaataatctcaaaataatctctccattcgcttaacagaaattttacaccacttattgtataatacgagagtcacaaggtcaacaaagacaataataacagtatacttaaaagtttgtatagaaacaattttaagtatctaatgagtaagggggtaataaatattttgaaatgcaggaaaatatcacagtttattttactcatcgccggtgtgagtatgatgagctatggcgctgttagaggcgaagctgccgttgtgcttggtaaagcaataaaattatgtttggagtgtgtaggaattggataaaaaaacaagtttaatatcaaaaaaaatagccagcctgcgtggcgggatacaggcggctgccacattgcttaccaatatacatcttcctaatttgtttaagggaaaaatatatcagggaaatgcaaaaacagtatgtgtgccgggattgaattgttattcctgccctgcagcgacaggagcctgtccgatcggagcttttcaggcagtagttggttcatcgcagtttaaatttacatattatataaccggattttttattttacttggtgtaatgttaggaagatttatatgtggctttttgtgtccgtttggatggtttcaggatttacttcataaaatcccggggaaaaagttttccacagaaaaattaagattattaaggtatcttaaatatatgattcttttcgtttttgttatatttcttccaatatttataacaaattcgattggaatgggagatccgttcttctgtaaatatatttgtcctcagggagttttggaaggggcaataccgttatcacttggcaatacggctattcggtcggcacttggtaagctgttttcttttaaacttatcattttaattatggtaattcttttaagtatcctgttttacagaccattttgcaaatggatctgtccacttggagcgatttattcactatttaataagatttcatttctcagcataaaggttgaagatgataaatgcgttggatgtcatcagtgcacaaaagtatgtaaaatggatgttgatgttataaagagtccaaatcatccggaatgtatacgatgcggtgcctgtatgaaagcttgtccaaaagatgcaatccactatcagtttataaaatttaatgacaaataaaaggaggttttttattatgaaaacaagaagaactattatcatgattcttacactttgcgtagcgttatcatttactgcatgtacaggaaagggagatgttggaaaagcagactcttcatctgtatcagagggaacggaaaagacagaagatttgcaggcgaaactggatgatttataccagcaggaaaatgagatttttgaaaaacataaagatgtctgggaaaaagtatttagtaagatgtccaaagcagatgccggctcggataattatgccgaataccttgcttccacagtggaatcaaacaaaaactcttttacggatgatgaattaaaaacattaaaagaagatattgagacaatccgtggaattgaagagcagataacagaagtcgacaacaaattagatacatcaggtgcttctgattccaaagatgatgataccattgcttttaataatgtttcaggaaaagattttgatggaaatgacgttgaggaaaatcttttttctaaaaatgcagtaacggttatgaatttctggtttacaggctgcaagccttgcgttgccgaattatcaaagcttaatgaattaaatgatgcgataaagtcgatgggaggagaagttgtaggggttaataccgatacattcgatggaaaagaagctacaattaaggaagcaaagaaaatacttgaaagtcagggagcaaaataccgaaatttcgcattggatgctaattcagatgcaggaaaatatgcctctgagatcatggcatttccgacaacaattcttgtagacagaaaaggtaatattgtaggagagccaatggttggcggaattgataatcaggagaattatgatacgcttatgaagcggattaagtccgtaatagaggcggatagtgcaaataaataattaagttatcctatactgtttgtttaaaaaagaataaaaatattttacaaagtcattcacagtaatatataatacaaaagaaatgtaaaagagaaatctaaaaaaggtaattgattgggagtacaaaataatggaagacagaaatcagttagataggatattttcttatatcgacgaacagaagaatatggggaagacggttgccgaggaagatatagaagagaagaattataaggcacaggaattgtggaaggagaaagtctggaggggatatgctgagctgaagaaagctggttttaaaggaggagatagcctttttttgatagcggcttattttgcaggtaagccagataagacgataactccacttttaagaagacttcagatggttatgaaagagagagaagatttaattagtggaggaatgctggcagcttcttattatggtatggaggaactttctatgcgtattcctgttttagaagagggagtcaggaatttgtatgcagaccaaaaagatatagaagctcttactggaagtataatgattgcagatggaggacctgccgaagttgccaaggcgatacagtggtatatgtttttcgtcaagaatggatttgatgtgaagaaacgccagatggcaagggtgattggacttttggcagtaatttcttcttcccctgtgatggtcggtagagaattaatgaatagaaccaatgagagtataggaagatatgagaatgaacaaaaagataaaaactatatgcaagatactttttgtgaacaagtatgtacttatatcaagcaattacagagaaaagagcaggaaaaagcaaaaaaacttggaaagacaagttataggatgcttactggggagaagaatgttacagtagtagattatacacaagaggaagaagtgagcttgaatggaagcaatatgcttgtaggtatggaacaggaagtaggattaattctttcagcaatacatatgggagtatagtgctaagagaaagagagaatatacaatgaagaaaaattataaaatgacgatttgttatgatggaagccgatattatgggtgggagcatcagccagacagagatacgatacagggaaagcttgagaatgttcttacaagaatgtgtggagagtttattgatgttcttggtgcaggcaggacagatgccggggtacatgccagagggatggttgcaaatgcagtttttgatgctacagataaagaaagaggcgggagagagaggactcctgatgagattcgggattatatgaatcgatatcttcctgatgacattgcagtaaaagaagtgagagaagcttctgaacgttttcatgccagatataaagctgtagggaaactgtatcgttatacctgttatgatggaccagttaagcctgtatttcagagaaaatatgtggctgtattagaaaaacgtccagatgtggaaaaaatgcagcaggcagccgcatatctggaaggcaagcatgattataaaagtttttgtggaaatcctcgtatgaaaaagtctacagtacgtgttgtagacaagattgaaattacgagaaagggaagttttatttattttgatttccatggaacaggattccttcagaatatggtgcgaatacttgtgggaacacttctggaagttggtaaagggaagataaaaccagaacagatcccagaaattcttgaagcaaagaaccgccagatggcaggaccaacagcaccggcacaggggttgtgtcttattaaagtggattattgatttcggggattagacaaataggtgttggctaaatagacgaatactggaaggaaaataatccctatctgtgactttagtcgcggcgcgttgaatgttcgcttatgcgctcgcattcaacgcttgctccgaggccacagatagggattattttccttccagtattctgtttttcagcaatatttaatgagtcaaatttagaaatctagaaagtttcgctctttaataagtctgggatgaattaaatcagaatacataaattcttctgatttagaaaatactatctttcagtaagatgatgaatcaaagtgaaagaaaggtggtattttatgaagcaaatgcagggaaagcagagtattttatttcaaaatccagtaaagatactaagccatgcctgtgtgggtggtaaaaaagagggtgagggaccgatagggaaacatctggatttgattgtagaagacccgatgtttggtaaagaaaactgggaagagagtgaaagttgttttttgaaaactgctggagagattgcgctgcgaaagggaaaaaagaagaagaaagatgtgagaatggctttttgtggtgatttgttagggcagcttattgcttcttcttttggaattgcagaacttgaaattccttattacggtgtatatggagcctgttctagtataggggctgctttgtctataggggcgatggcagtgaatggagggtttgcggatttggtgttatcagggtgttcgagtcattttgcgagtgcagaaaaggagtttcgttttcctcttggctatggaagtcagcgtccatacagtgcgacgtggacggtaactggagcgggagcctttttattaaatgaggataaaggcgatgtgcagattcggggaattacaacggggaaaataaaggattatggtgtgcaggacccgtttaacatgggagcgtgtatggctccggcggccgccgatacgatttatcaaagttttatagattttgagatggaatcagtagattttgatagaattattactggagatttgggagcagtggggcagaagttactttttgaattgcttgacgagaatcataaagatattaagaaaaatcatatggattgcggaatgcagatatttgatgaagaaagtcaggatacccatgcaggaggaagtggatgtgcctgttctgcattaatgctttcagcagtgatattgccgaaacttgccagtggagaatggaaaagagtgttgtttgtaccgacaggggcattattatcgcaagtgtcagcaaatgagggaagaacgattccggcaattgcacatgcagtctggttagaatccggaaaggagtaggggaaaaggatgatatatttaaaagcatttgttgtaggaggcctcatttgtactttagtacagatttttcttgataatacgaagttaatgcccggaagagtgatggtgttattagtaatagcaggagtcattcttggagctgcaggattatatgaacctcttataaaatgggcaggctgtggtgcaagtgtcccgctgtctggatttggatataacctgtcaaaaggagtgatagaagcagtaaaggaagaaggggcaatcggtttatttaaaggcgggttaaaagctgctgctgccggaacaagttctgcacttatcttttcttatatagcctcacttattttccagccaaaaatgaaaagataatgctttgcttcattttagccgttttttaaattcttgaatagagattccttctattttctgaaatactttctgaagataactgctctcgttaaagcctagcataaaggcaacgtcagaagtgttgtgtgtggtaaagataaagttaatcttgaccatttgaatcttgcgaagacggatatattccattgtgctgatgccgaactggtcacgaaaaatacgacttaaatatccctggctaatcatgctgccttctgtaatctggcctaaagaaattttttctttgatatgctgctcgataaagaggaaaacgccctctaaaatactataacgccgtatgcttttttgttggtagatataatccattattttaaaaagccaaattttcatgatttcgccattaacaagccaggtatcaggtaaaggaaataaatccgtgatttcgttacgctgatccgcatactcaagagaatctaaaaggccatgtccaatctcgataaaagtcttttttaaagattcaatacttgcattctggctggagaaaatctcattaatgatagaagaaaggccagcataggtttctgaaaaactctgagaattagctaattccaaagcctgagaaagctgagggcagacacttttataagtagaaggagaaaaattctccagataggtgcttatatcaagaaaagatactggcttggaaaagtattttttgatatgtaattccattgcttctttggcaaaatgaaagtcggagtaggcagagaggatgcatatttctgtctgaggggagtcttcttttatctttttgccagcttcaatgccggtcatgccaggcataatgatatccataaaaataagatgtacaggatagaggcggcagatggcaatcgcttcagcgccatttgctgcttccccgataatctgaaagtttttaaagcgtgaaatcatggcacgcagtgcatttcgcattaatgtgtcatcgtctacaattaatacattgtacattacataatcctttcctcatgagagattggtaacttgattatatcatggattttagaattgttctggtaactctctttgatttcataattattgccaaaaatgctgtagagtctctgtcggatattgctgataagagagcgaaacgtatcattatccggaaagtttttgaaagaagaagcaggattactttcttcattatccgggttataatccgatactatatcgatcgtggtatatccattttcacaggaaatagaaatggcaatatcaaggtgtccagtatttactgtgatcagtgaggctgcccggtctaaaaatggaaaaagaatatgcgaaggtattctaagcatatctatttcttttttcgcagtaatagagtaggtaaaggcatcttcatatttgatttttagcatgttaaaataggattcaatctgctttaactcatcggaaagtaagatattatctcctgtagtgcacaaactgtatttcaaatactgagccagagcgacagccatctggtttgtttttggtgcattttctaagacagaaagatttgcaatgtcagtgagcagggacaaaataaaatgaggggtcaattttgcctgcatataatttaattctttcgtcagggaagaattttcatattctagttcattaattttagaagtcagcttttgttcctgtattttgtgggaatcatattgctgctggcgaagcatttcattttcggcaagctggtttaccatcaggtagataagttcagcaatatctgaaaatttttggtattcataagttggtaattgcgcaaagtattcatcaacctgagcctgatcttcctcaagatattctggctgaataagaccagagaagcgtggaatatcatctggggcatcgttacatctgacctggccggaaagaaagccgcctaagaactttccatgaacgatgattggaatagcaacttccatcaatccacaaggacaaaaatagatgcagtatttacgggtgatagcagaacggacaataccaaatgcatcagagagattgcacaattttccattatttccacgctctctggtaaatttgcaaaaaggggtaaatccggtcatgcaagtaagtggttccccgcgaaaatcggcagtaacaaaaccgagtccggtaacttttgaaatgatagactgcagattttctaaaggttctttaccaaataattcaaggataccgacatctgtatcgaaatttcctctattttgttcgtcattattagaaaataaatctttttcagtgtacaatgtgctctcccttctatagtaatttcataaaatactgtaaaaagatgatgtggcatagcgcagtaatttacgttatagagtgcttagtttttgtagtattttatagaattgctgtaaaaccctcaaaggggttgccacagtaagagggtaggataaggtcctcctgtggcagccccggaaattttatgatgcaaaaggattataaatattaaaaatcaataagtttctaaaataatttttgaaataaatttctattctcgtttatttactcagttagtgccaattaaaatttagaaatgctgctctgttctgctgatgatgtcatcctgaacttcttttgcaagttcagtaaacattgcactgtatccagcaacacgaacaactaaatctttataattttctggatgtgcctgtgcgtcaagaagtgtttctttatcaacaacgttaaactgcacatgcatacctttcttctcaaagtagcttcggataacagcggcaaagttcataagaccctgatctccggcgactgcggaaggaaggaatttctggttgtaaagagtaccgttagaagcaacttcatggtcaagtttggcaacagaagcggctgcggctgtagggccttttacgtccttaccagctcttggggaacatccatcagcaagaggtttcttagcaagacgtccatcaggaagtgctccaacatctttaccgaataatacgttagcagatacaggataaataccagcctggaactgtccaccacgagggtttctgtatttttcaacttcgtagcaatacatctgtgcacaacgtcttgcaatcatatcaacttcgtcaatatcattaccgaagcagtctgtagcatccatcatagcacgaatacgctcatatttttcattgttgcttccacaagcaggagcggcagtagcagcgctcttattgatattaatgccttctttaccaagaatcttgcagatctggtcatataaatctttttcgatttctgtttctgcagatgcagcacaaggagcaacttcaccatcaacagggtaaccgaagtttgcatccatagcttcttttaactcagcaaaagtgatatctttgtcatcaaagacatgtttcttgattgcgtatacagagtcaccactgtcggcaacaccgaatgcctgaggaccagtaaagttgtatttagcaccaccagcacagattcccttcgcatcggagatacagtcagcaacaaagcttgacaggaatggaagttctccacgttccatatgagcgtaatctacacagttatctgcttctgctacatagtatacaaagtattcaatctgtttctggaatgcctgcataaagtcttctaaagtcttaaatgtatcaacttctccagtcttaggtccgatctgaaggtcgccgattctaccattgttgatagtgatttcaagaatcttagcaacgtttacgaaagcagcatcatgccagccctgttcttttcctggtacagatggttctacacagccgataagaccgtaaccacgggcatcatgaagagaaattccacggtttgtaagagctgggataataacttcatcgttgtacatagcaggaagaccataaccaagtcttgcaagctcacatgcacgataaaggaattcatcaggtgttccctgccatacacggatggagaaggaaggtgcgctaagacgaaggtgagcaacggtttccatcatcatataagataattcatttgttgcgtccataccatcttctgtctgtccgccggcaccgatgttctggaatacctggaatcctgcaaatgcctgagcagaaatctgatcacgaactttgttaaggtcatttaattttacaaatacacagtctaataattcctgagcgaaatcttttgtgatagcaccgcttgctaaatctttttcaagatatgggtacatatactggtcgaaacgtcctggagattcagaatgtccgctggactctacctgaagaatcatctgtgtgatgatgaaagactgacaagcttcatagaagtttgtagcaccatttgcaggaaccttttcacagtttgcggcaatctgaagtaattcagcctttcttgttgggtttgtctcaacagcagccatctcttttgctttgtcagagtaacgttttgcaaagttgatagcagcagacaatacggtgataatagccttgcagaactgtgttttctgaatgaagtcagggtcgttgcagtcgaagctttcgagtgcttctacagcatcctgaataattgccttgtaaccacgacggatagctttatcataatcaatgataatatgtccaacaccaccaaagaagtagttacctacagtaaatacaccgttagcgatacattcttttgttttttcggacatatagctagaagcaaggtcactgattgtcttatcttcccagtaaggaagaacttttcttaaagtagccttatcttcttcagaaatcttaaatgggtcagccattctggtttcgatggtatcgaactcgtccataacccatttgtaagagttttcagggaaaagctgacaggaacgaacagcttttgtaagggtaccaactacaagctcatcgtctcggattgtaacagtaagattgtttaaaatgttctcgagagctttagcacgacgcataatcattggaagtccttctgttgcctgataggactcggtaataagtacggcacgttcagcctcgatacatggaactgcatcaacaatcatacttctaagacgctcaactcgatcagttggttttgaaaaaccttttgctaacataaaattcatcctcctttaaactttgttctcatggttttccggtatctatgtatccgtcgcacgaaatacataatataattatatttttaacagaaggaaaataccaataaggaacaaaccaaaaaaaggattttcaaaactaatttaagtttaactttttgcaggaaaaacagagtagtaataaaaagtatattttattggaaaatatgaaagtgaaagagaaaagaaaatgaaaatatcccatgttagaggaaaaaatatatctaacatgggatattcttgtaggtttaactttggtaagttccttttagtttagcagttttttgatttgcttttcaatgttattgatagaagtgtctgtagtatcattccctgactgctgttgtttctgttgtttttttaatttctcttcctgttttttctttttcttctctaattttttctgatgccattcttccgtgtgaatattgcacttattgttgatatcaatattcaggaagtaaggttcatcatccgtcttatgagaagagtgttttggacgaacacggaaaatctttgtgtagcggaacttatctgggcagaacttctgtgcaactaaatgagattttaaacagaaagtaactgcgatatgcgcatcacaactatctttcggaacggttcccgatgcaaaatattctgtgcggaccattgacttttcaggatcttttgaacaaacattaggaagagctttcttgccggatttgatacagatctccgcttttttaatatttttattggaaggaaaacttttcactttttgtttcttttcgctgataatgcgatccataatctttttccagattactttatggtaatcttcatcattatcaaaagaagtgttatagtcataacctgtccagacagatgccgtgtagtatggcgtatatccgcagaaccagtagtcatagttgttagaagtagtacctgttttggcggcaacggccatatctgaatcaagctgcgcagcccggccggttccttttttaacaacatcctccatcgcatttgtaagaagccaggcggttgatttctttattactttgcgagatttctttttgttacttaacagaacattgccattactgtcttttacagtcgtataaagaacaggggtgttataagttccctgattggcaatggccgcataggcggcggtcaattccacattggttacaccatctgtaattccaccaagagccagagactggtttacatcactttcataagtaccatttgtacttacccgattatttactaaagttgtaaaaccaagtttttgcagaaagtcaaaaccgacctgaggagtcaggtctgtgagggcttttactgcaacaatattgttagaatctatgatggcatcacggacagttgtaagtcccttataacttgttgaaacatagtttgtaactttttgtccattctcatactgatatggggcgtcatcaaataccgttgccagtgtcatacttcctgtatcaatagcgggagcataagtagataaaatcttaaatgttgaacccggctgccgctttacagatgttgcgcggtttaaggcgagatcgtcctgcttttgtccgcgtccgcctactagaactttaacctggcctgttttttgatcaatgagagagtaagatagctggggttccatagaataatgtatggattcggccttctttttgtctccctttttcattacagactttcgaaatgcttttacagcggctttcatttccttttttgaattataaatcgttttataagttggatcttttttctttttgcggaaataggaagcaacatttatttctgtataagtactggatgaagagtcagcatgcgttacctgaagtttatattctaaggaaaacttggtagctaccggataattatctggattattaataacagaatctgcaatcttttgtagctttgtgttttgtgtagaataaattttcaggccaccgcgataaacaagctggtaagcctgcgattgcgtatatcccttttgttcctgaagatcagcgacaatctgggtgataagcgcatctgtaaaataggaatatacagaatttttgtttcccttggcggtatggctcttaatctttgcgtaaacgttatcctcagaagcctgctggtattctttcgcagaaatataatttaattgatacatcttttttagaattagtttacgacgtgcatcattcgcctcaggataatctaccggatttaagtaagtcggattttttgtgattccagctaaaacggcacattctgataaggtgaggttctttgctgacttgccaaaataatatttggaagcggtttccaccccaaggttacctttacctaaattaatggtatttaggtagtcggtaagaatctcttctttcggctttgttttttctgcattaattgcaagatactgttcctgaatctttcgtttaatctttgcaatgatattactttcaccgccagcttcaaatacattattcttaataagctgctgtgtcagtgtgctggctccctgtgaggtggaaccattgcgcagatctgtccacaaagcacgcaaaatccccttaaaatcaacaccgtcatgttcataaaaacgttcatcttcaatagcaataaaagcatttttcagattatccggaagctcctcagactttaccttaatccgattagaggaataatcatgaagaggctgcactgctttattattatcgtcatagataatcgtagaagaatattttggtgaaagagagacatttttaggtgcactggcaataatacctttaaaggagccgtaagctaatccggctccactgacacatatcgcacaaataagaaataaaataacacgaaaagcaactgccgaagcggttgttcgtcttcttttctttggggatgaaagttcttctcgtttcttttttatagatggttcattataattcataagtatatcctgtcatatggatgaaaaagttatcttaccggaacgatttcaatccaatatccgtctggatcattgataaaatagattcccatagaaggattttcgtagcaaatgcatcccatctcttcatgtttcttatgaaaagcatcatactcatctgtcttgaatgcaagatggaattcttcatctccaaggttataaggctcttttctgtcgcgcatccaggtcaattcaagagtaaagccggtacgtccgtctccaagatatacaatcttgaagcttccgtcactggaatccttttcgcggacaacagaaagaccaattgcttctttataaaaagcgatactcttttctaaattaagaacattaaagttaaaatggttaaattcaatcatggtaaacctcctttgtacatgtcaactataaatttgcctgtaactattggaaaatgattcacaaaaagaccttccgaatatatatactgtttgtgaatggagtcactatagttacgattgctatgatttgtattataacatagaagcacgggcagggcaaatttgcaaatttacaaacttctgctttacaaaaacgagaaaaattatataataaaaatggagttttgcgtaattaccagaaagtgtttgaaaaatgcttacagcaagatgtatgttacatttgcaggagagtgtcagaatgatttttcaagaatgcttcaagatgcaatatttcagaagagagaaaggagaggaaagatgaagaaaaagagaatgctactactagctgcaatgtttgtttttacatttgcctttatccgttttaatacagtggatgtacaggctgccagcaagtatacgatttatgtgaaccgcagaacaaatcttgttaacgtaatcaattcaaaaaccggcaagcttgtaaaagcaatgtattgttctactggaagaaattatagaacaataagaggtacatataatacaacagcaaagtataaatggagaccattgattcacggggtttacggacagtatagtacaagaatccacggagcatacctgttccattctgtaccttattatagtatcaataaaagtcaggtatccacaaaggaatataataagttaggacagcaggcttctgcaggctgtatccgtctggctgtgacagatgccaagtggatttatgatcattgccgtcttggaacaaaggtagtaattggagaaggacgtacattaaagaagccgactcgcccaaaagtaagggtatctactaaaaagagagctggatgggatcctacagatccagattcccgtaatccgtaccgtccaaaacttactttaaagaaaaaggcaacaaagacgattgtttatggaagtacatttaatataaaaaatatggtaaatgtcagttcttcctatgcttcatccgatgcattgttaaagtcgatgaaggtaaagggaaaggtaaacacaaagaaggcaggtacttataaagtacagtgtaccattactgatccatatacagcagtaagcgtaacaaaaacatttacctttaaagttggaaagaagccaaagcagacgacaacagaaaagaaagctccaacagagttaactacagaagaaaaaacagcagaataatttatgctaactatcatccacccgtcagttaagaactgaaggaattggatataattatattatattttatgatacaggaggaaaaacctatggcagaaccttataaccatagagccattgagcagaaatggcgtgacaaatgggaagcaaccccaatcaacgtaaacgatggaaagaaaccaaaatattattgtcttgatatgttcccgtatccatcaggaagcggacttcatgtaggacactggagagggtatgtaatcagtgatgtatggagccgttacaagatgcttcagggatattacctgattcatccaatgggatgggatgcatttggccttccagcagagaactatgcgattaagatgggaacacaccctaaaattactacagcttctaatattaagaatattaagagacagattaatgaaatcgcagctatctatgactgggatatggaagtaaatacaacagatccaaacttctacaagtggacacagtggattttcgtaaaaatgtttaaagcaggtcttgcttacgaaaaagaaatgccaatcaactggtgcccttcctgtaagacaggtcttgctaatgaggaagtagtagacggatgctgcgagcgttgtggttctcctgtaacaaagaagaacttaaaacagtggatgcttcgtatcacaaaatatgcagaccgtctgttaaatgaccttgataagcttgactggcctgaaaaggttaaaaagatgcagacagactggatcggtaagagttacggtgcagaagttgacttccctgtagaaggaaaagacgagaaaatcactgtatatacaacaagaccagatacactccacggagcaacatttatggtattagctccggaacacgcaatggcaaaagaacttgctacagatgaaacaagagaagctgtagaaaagtatatcttcaacgcttccatgaagtctaacgtagatcgtcttcaggacaaagaaaagactggtgtattcacaggttcttatgcaatcaacccattaaatggagcaaaagttccaatctggttatctgactatgtacttgctgactacggtacaggtgcgatcatgtgtgtacctgcgcatgatgaccgtgactttgagttcgctacaaagttcaacatcccaatcattcaggtaattgctaaagatggaaaagaaatcgagaacatgacagaagcgtacacagaagctgccggaacaatgattaactctggtgagtggaatggtatggaatcttctgtactgaaaaaagaagcgcctctcatgatcgaaaagatgggcatcggaagaaaaactgtaaactacaagcttcgtgactgggtattcagccgtcagcgttactggggtgagccgattcctatcgtacactgtccaaaatgtggtgcagtaccagttccagaagaagagcttccattactgttaccagaggtagaaaaataccagccaacaggaacaggagaatctccacttgctgacattacagaatgggtgaacacaacatgtccatgctgtggcgctccagcaaagagagagacaaacacaatgcctcagtgggcaggttcttcctggtacttcttacgttacgttgataacaagaacgataaagaattagtaaacagagaaaaagcagataagtaccttccagtagatatgtacattggtggtgtggaacatgccgtattacatctgttatactccagattctatacaaagttcctcaacgatattggggtaatcgactttgatgagccattcaagaagctctttaaccagggtatgattactggtaagaacggtatcaagatgagtaaatccaaaggaaatgtcgtatctccagatgatcttgtaagggactacggatgtgactccttaagaatttacgaactctttgtaggaccaccagaacttgattctgaatgggatgataagggaatcgaaggtgtaaaccgtttcctcaaacgtttctggaagcttgctcttgacaataaggataacgatgtaaaggcaacaccagaattaatcaaagtacgtcataaactggttcatgacatcacaaaccgtctgaacagcttcagcttaaatacagtaatcagtggattcatggaatacaacaataaactgatggaactgtctaaaaaaggcggcgtagataaagaaacattggaaacatatatcatcttattagctccatttgctccacatgtttccgaagaactttgggaacagtttggacataccgattctgtattccacgcaacatggccagaatacgatgaggaagctatgaaagacgatgaaatcgagattccagtacagattaacggaaagaccaaatgcacaatcgccatcaatccagatggagataaggacgagattcttgcaaaggcgaaagaggcacttggggataaagtcaatggaacaatccgtaaagaaatctatgtaccgggaagaatcgtaaacttggttgttaaatagtaatttgccgttaggcaagacggacgctcccaccgggagacgatatcctatatttgtgactctatcactgcgggttgaatgttcgcttaagcgctcgcattcaatcctcgctctaaggccacaaatataggatatcgtctcccggtgggagctgttttttgttggacggaaattactatttaatgttggggtgctttgggaaatcgccagaaggattattaagaagaacccctagaaaatttattgattttgttccgttgtgctaaacgctccattttgcccaataaagcagaaacttgctctcaaaacctccactggagcttttttctttgagggcatctattttgcctgcggcaaattcttatttaacataatatagcaagaattctccttcctctgcaggtgggagatgaattgcgtaaaaataaaaagagaacacttgttcaataatgcaatccatggtataatagagtcagtagaaaaggaaaaataaatcataatgcgcattcagtatatatgatgtactatcatctgatcatggtagtgagatatcgaagaaaagtcattgataatccaatttcagaaagagcaaaagggatatgggaacatattgctccaaggtatgggattgttctggaagaatggaatcatgacattgatcatgtgtatgtaatgttccatgcacagtcgagaatggaacttagtaaatttatcaatgcctgaaaaagtgccagtagtagactattgaaaaaggagtatccggaaatcagggaaaagctttggaaagaagccttttggagtcagagtttctgccctgctgacagaaggaggggttcgggtataagtaatccatcaagacattgaaacccaaggagggaaaaagtattgaacatagcatgtcgtttccgaatttatccgacagaagaacagaagatacttcttggcaaaacatttggctgttgtcgttttctgtataatcagatgctcaatgataagatccgggagtatgaaaagacgaagaaaatgttaaaaaacacaccggccatgtataaaaaggaatatccatttctgaaggaaatagattcgctggcgctggcaaatgtccagcttcatttggaaaaggcctataagaatttttttcggaatcccaagattggatttccaaggtttaagtcaaaacatcattccaaaaacagctatacaacgaatgtggtcaatggaaatatcctggtggaaagtaagcggattcggcttcctaaattaaaatggatcgccatgaaaaaacacagggagccagcagaaggccttcgcctgaaatcagtgacggtcagtatggaaccatccggaaaatactttgcaagcttattttatgaaggatacagctgtgaaaaccaagctgctgaaccggattacagtactgcaaagatacttgggattgattatgcaatgcaggggatggcagtgttttcagaaaaggttgagacagaagaagcaggatttttcagaaaaaatgaaaaaagactggcaagggagcagcgaaagttatcaagatgcgtacgaggaagtcataattatgaactgcagaaaaagaaagttgccagatgtcatgaaaagatacgaaatcagcgaagggatcatctgcacaaacttagccgaaagattgcagacggttatgatgcagttgcagtggaagatatcgatatgaaagcaatgggtcagtgcctgcatttcggaaaaagcgtacaggataatggatatggaatgtttagggaaatgttagactataagctggcatggaaaggaaagaaaatgataaaggtagaccgtttctttccttctagtaaaaaatgctgtaaatgtggaaggataaagaaagagctgaaattatccgaaagagtctatcactgtgcgtgtggaaataagatggacagagatcgtaatgcggcaatcaacatacgtgaagaagcaagaaggatgttgacagcataaactgtccgtatctggacaagctgataataagaaaatatacccatgtccgggcaaaagaatcgcggggcacgcgaggatagcttgtagatacttggctcagtagagccattgagcaagaagcccccacttcaaaatctatgatttaagtggtgggagcatgtcacagaattcccccttgattttggttggaaatagtagtaaagttttacttgaataacgattatactatttgaaagaagggtttaagttgagtaaaatcgaagaagtccgtactgcaatgtacgcagcaatgaaagcaaaagataaagaaagaaaagatgcattatccatgcttcttggtgctttaaaggcgaaggcaatcgataagagagaagatttaacagaggcagaggagaacagtatcattgcaaaagaaatcaaacagtgcaaagatacgattgagatgtcacctgctgaccgtacagatattatcgaccagtgcaaactgagaatcgctgtttatgaagaatttgcgccaaagcagatgagtgaagatgaaatcaaagcaacaattcagtccgtacttgacgaacttggaattacagaaccaacaggtaaggacagaggtaaaatcatgaaggaccttatgccaaaggtaaaaggtaaggctgatggtaagctcgtaaaccagatggttgcctcgatgttgaagtaattgccgcaggcaaaagagacgcccccgaagagaatctaacctctatatttgtggcctcggagcaaggtttggatgcgagcgtttaaagcgagcattcaaaccgccgcgactaaagtcacaaatataggagttagactctcttcgggggcgtctctttgcctgcagcaaagtcctatttagcttttgccagtaattcttcccattttctatcaacctctgcctggattcttgcgattaattcttcttttccgggtttgaataaatgtttgaatcttctctgtgggcgtaagaagtcttcgattggcagttttttcttaggaacatagtttacgatccattcgccgtcaatgacctcaaataatggccagaagcaggtatctactgcaagctgacagatttctaaaatgtctggtgtgttgtaacgccatcctcttgggcatggagccatgacatttaagaaagcagccccttctgtgtagattgctttttctgcttttgtgtgcaggtctttgaagttctgcacaaaggtagtctgtgcaacataaggaatattatgtgcagcgattacctgtgttaagtcttttcgattctgtgcttttccgtcagattcggaaccgacaggagtagttgttgtgtcagcatacattggagttgcggaggaacgctggataccggtgttcatgtaagcgccattatcgtaacagacgtaaaccatatcatgatttcgttccattgcaccggataaagactggaatccgatatcgtatgtaccgccatcaccaccgaaagtgatgaatttatgagtgcttttttacttttccttttttctttaaagcacgataggcagcttctactccactgcaggttgctccggcattttcgaaagcattatgaataaaagaatctttccatgcagtgtatggatacatgaaggaggatacttcaaggcacccggttgcacaggtgataaccgcttcgtcttcttcgtgaagtccacgcagtacatttcttacagcgatagttgcaccacatccggcacacattctatggcccgggataaacgttcttctgtgcgaaacacttctgcagtacagcttccgacgatggtgcatcccggagtaagattctgccattttacatcaagttcgagtttgttgatatctgatatcattattgtacctcctgtaaagcaagggagagagccttcatattaccctcgatcacctctggttttgaagcaaatttatgtgcgtacgacttctgcatctctgcaaggaaagcttcgtcatccataacaccggatacttttacgatagcagcaagcatcggtgaatttggaaaatactttccaagtgcttctaaggaaatctttctggcatcaattgtgtatacgcggcctttatagccatttaattttggtaaaagttcttcttttgcatgttttgtattgatgatgattgccccttcttctttcaggccttctgttacatcgacagaatctaaaagcgtttcatccacaacaaccacataatcagggtcataaatattagaatggacgcgaatctgcttattgctcagacgattgtatgcagtaatcggcgcacccattcgctctggaccatattcagggaatccttgcacatacattccagtactgaaagctacatcagcaagcagaagtgccgcgaccatgccagcggatttcaattaaatctttcatgttatcctccaatttgtattctgtgtactctcaaaatgttaagtaatcgcaattatatatccgttttagattgtgtttgaaaaataaaaaagcattttcaaatacgttcagatagtagaaattctgagagtacatttcttcctaagtaaaaggaaatgtgtttctataaaaaactcatgtccgtactacacggaaaaaagacgtaaaaaatataaacaatggtaatcgtataaaaaatcattgtttaaaatagccttatatatgaattttgttaaacctatgtactaccataaatccgacaaaaagaaaatgaaataaaagttgagaaaaatgtcgatttatgatagaaacgaatcgattataacagacaaactttcatttgtgaagtctaaaagagaaaaaaattcaaaaattaagttaccagccttccggcaagaagatgcatgcctttaaggataccactgaaaagttccacagaagggaaggatgttactctttgataacactacttcccctgcggttatttttaaaataaacatttaaagtattctgttgattccctgttgcaagaaatatgtcagacaggcgtttacagccatgtgcagaaagctgttttctgagccattcctcatcttttccggaatgtaagagattctcataaagaattttcccatccatgatataggttggaagcagccattctttgtgcggcgataaattcaaatccgacggtgagacaggacgatgctccgattttgcaagaaaactgatgcgaccattctcttcaagaatcgccgtctgtaattccttcaaatcaaaaaatccatttaaacggcattgcacaagaaattcggacagatcaatatgtcctttcttaaaatttccttcatataaatgcccatcattaaacaaaatataaggcgaaccagaaataaaatgccgtatcttcatattttttcccgtaataaaagcaagaaaagccgttagtagcccataaacaatcatagctgtaagcggttctaaaaaactcgaatcaggagctgtagccatttcagcagcaatcgaaccaattgtgataccactaatatagtcaaacatgctcatctctgacatttgtcgataaccgattaattttgtcagaagaaaaaggacaactagagaaaaaacagacagaaaaataacatataaaatatccataaaacctccttggagaatttgtgctttggggctggctaaagagacgaaccttccagcatactatatggcatttactctgtagtcgctgcgcgcaaaatgcctttagggcatcttgcacttgctccgaaaccgtaaatgccatatagtatgccaaaaagttctgactttggcatgttgcaaagcagaaattctagttgtgtgaaatgcaacagcaaatttgagtactacttaagttctaattaagatgtgaaattgaggtaaaaaatatacattttacggtagaaaattttcgtggtaaaatgtttatcaaatgaaagaaaatatgtctttttaaaaatagtctatttattttattactgtaggaaaatgtggataatacgaaatttaagatgccattaccttcagaatacaattacaaatagcgaaaaaatttttgataccaatagtataaatcactttactaatattgcaaaagtgttgagaggaggagtttcagagctaataggtaattacgaatatttgcgcatattgccacagcctagtgaagtcaaaacctttgggatggtaatgattcgcaattgctttactaatgttataaaagtatttaagggaggagtttcataccaaacaggcaaatacgaatatttgcacatattgccacagcctggtgaagttaaaaactttgggatggcaacgattcgtaattgcctgtttggtatgaaactccggtctaaatattttagaaaggagtatattttgagcaaaaattacagagcagaactcgttggtctttttggtaacccagtagatgaaaatcctaccggccccatgatggaggcaggttttgcagcacaaggattaaattacagatacattaccatgaaggtagaaaaggaaaacttaaaagatgcaattgcaggaatacgtgccattggcatgagaggattgaatcttacgattccacacaagattgcagtcattccatttctggatgaactttctccagcggcaaagattattggagcagtaaactccattcgtgtacaggatgggcaactcattggggaaaatactgatggaaaaggctttgtcacatcattaatggagacagggatagaactaaatggacggataataactgtacttggaagcggcggcgcagcaagagcagtagctgtagaatgtgcgatttcaggagcggaaacagttaatattgttgctcgcaatgaagaaagaggtaaagaacttgccgatttaatttctgaaaaaacagaagcgcagggagtttattttacatggaaaggaagcgtacctattccagaaggcacagaagttctcgtgaactgtactaatgtggggctttatcctgatgaaaataaaccagatataacatatgaagatatcaggaagaacatgacggtatgcgatgttgtatttaatccaccagaaacaaagttcttaaaagaggcgaaagctcgcggagcagctaccgtcaacggacttggtatgttagtaaaccaggcagcattaaattattgtctctggacagaaaatatggcaccgaaagatatgatgaaagaagcacttttacgagagtttaatttggaaaatgaaactgtacaggaagagaaaactatacagaaaaatatagcgatacaggaaaaggtaacaaaagatacagtaaaaaatatgaaaacagatataacagatacagtcaatataatggaaaatactaggagaaccccagggcgttttcaggcaacacaaggagaagagaatatcatggatgaacaagacagaaaactaatagaaaaaatgatggaatattacgccggagaccccaaaagagtacagcattttctcaaagtctacgaatttgcaaaattaattggtgagtcagaatcccttgatacggaaacaatgcatatcctccgaaccgcagcgattgttcatgacatcggaataaaaataagcgaagaaaaatacggaagttccaatggaaaatatcaggaaaaagaaggccctgcagtagcagaaccgatgttgcttgcactgggatatgatgaagcggtcatcgaccgggtacttttccttattgcccaccaccatacatataacgagatagaaggactagactaccaaatccttgtggaagctgatttcttagtaaatctctttgaagacggaagcagcagggaagcagcccaaaaagtacagaaaaatatttttaaaaccaacaccggaacgaaatatctttctggcttattccttaattaaatagtaattcaattgacagttttccctctttggtatatgataaacttacattattttacttgctaaagggcagatgcccgataaaggaggaaacatggtttttggagtaattttagccggaggaatcggcagcagaatgggaaatgttgagaaaccaaagcagtatcttagcgttggtggcaagccgatcattcttcatacattagagaagttttatgtgaacagtaagtttgagaagttaatcgtactttgcccttctcagtggattaatcatacgaagaatctggttaagaagaactttaatgattctagtaagattgtagtgattgagggtggttctacccgtaatgagacaatcatgaattctattcgttacattgaaaaagaatatggtctggatgatgatacgattatcgtaacacacgattctgttcgtccattccttacctatcgtattattgaagataacattcgttatgcgcaggaatacggtgcctgtgataccgttatcccagcctccgatactattgtagaaagtgcaggacatgagattatcagtaacattcctgaccgttctattatgtatcagggacagacaccgcagtcttttaaggcaaagaagttaaaagagctttacgagggactgacagaagaagaaaaagagattcttacagatgcctgcaagattttcgttatcaaggggcaggacgtacatttagtagagggagaagtttttaatatcaagatcacttatccatatgacttgcgagttgctgaaactttgattaaaggagaagagaaataatgttaaatacagtgtatcgtctggtagcacccaggagatttgaagtagcatttaacgatattgatttaaatagtgataaggtagttgtgcgtccaacgcatttatctatctgtcatgcagaccagcgttattatcagggaacacgtccggcggatgttatggcaaagaagctgccgatggctctgattcatgaggcgattggtgatgtggtgtatgatgcgacaggagaattcaagccgggtgaacttgttgttatgattccgaatacaccagtggagaaggacgatgttatcgctgaaaattatctgagaagttccaagttccgtgcaagcggttttgatggatttatgcaggataatgtcgctttagacagagacagactggtgcgtttaccgcaggatattgatcgaactgtagctgcattcacagagattgtcagtgttagtgtacatgcccttcgtcgttttgaacgttttactcacgcgaggaagaatgttgtaggtatctggggagatggtaacttaggttacattaccgcagtatttttccactatatgcatccagataccaagctggttatctttggaacgaatgaagataagctgagtggttttacttttgccgatgagacccatcttgtatgggagattccggaagaccttaaggttgaccatgcgattgagtgtgtaggtggtgacgcttctcagaaagcaattgatcagatgattgatattatccagccagaaggaacaattgcccttcttggggtatcagaatatgcggttccaatcaatacccgtatggtattagagaaggggcttcatctttatggaagcagccgaagtggaagagccgattttgagaaaacagttgaattatatcaggaatatccagaaattctcggttacctcagcaatatcgtaggagcgcaggttgaagtgaactctattgcagatatgacaagggcatttgagatggatattaataagatgatgggtaaaaccattatgatatggaacaagtagaagctttgatgattatagaaattcaaagctataaaactgaaaaatgcaggaattaagaattaaaaatgcatattgacataattgacatatatgatatacttaattcataagttgaaggagcaacgattttcgttgctcctttttgttgtttcgtatactttttaagagatagatttagagcgtgtttcaaatatgctctggaatattgcaaaatagggcagaaaaatttttgcagactcttatatgaaataacagaaaaagtcttttgtagacgaaaatctaaaaaaagagaggagcaaaaagtatgctaaaaataagtaacattgtatcacagatagactcttttgtatggggaccagtgatgctggttcttttggtaggaacaggagtacttttaacagttcgttgtaacttcctgacatggagaaatcttccatgggcattaaaaaagactctgagtaaagaggcgcgaacaaagagtcgtggaacaggagatgtttccccgttttccgcacttacaaccgcccttgcggcaacaatcggaaccggaaatatcgtaggtgttgcaactgctatggtttctggtggagcaggagcattagtatggatgtggatatctgcctgttttgggctttcttctaaattttctgaatgtatgttagcgattaaatacagagaggttaacgaaaaaggcgaaatgtccggaggaccaatgtatactatgaaaaaagggctgaaaaataaaaagctaggtgcagtacttggctggctgtttgccctgtttgcagtaattgcttcctttggtatcggaaatatgacacagggaaattctattgcaacatccgttcacgcaacctttggtgtgtcagtaacagtggttggcgttgtgatcacagtactcgcacttttaattattattggaggaatcaagaccatttctaaagtttcttccgtagtagttcctgttatggctattttttatgtagctgccggaattatcgtcattcttggaaatatacataaccttccagcaggaatctctatgatatttaaaatggcatttagtgtgaaagcagtaggtggtgctttatgtggaaatatcgtagcatccatgatgaatgcagcacgttacggtgtagcccgtgggtgtttttccaatgaagctggaatgggttctgctgcaatcacagccgcagccgcaacaacggataatccggtaaggcaggcttatattaatatgactggaactttttgggatacgattgttgtctgcacgatcacgggtctcgccatcgcaagttctggtgtgcttggacagattgacccggcaacaggacagctttatgttggctccgcattgaccatcgctgcattttccacagtactcggaaaagttggtggatatctcgtaacaataggtattacattatttgctttctccacaattcttggatgggaatatcatggagaaaaagcttttgaatatctggtaggaacccataaactgaatatggtttatcgaattattttctcactggttgcttatgttggtgcaacacagactttggaacttgtatggaacttttcagatattgcgaatgcgttgatggcgataccgaatttgatctgcatgatattgttaagcggagaaatagcgaaagatgtgaaagcattccagaagataatcgatagggaaagataatttctgatttgccgcaggcaagaagaccaaagacatagaaatatccagaaaattaaactctataggattgatacataaactattatcatagtaatacaataatttatggttaggttactacttttttatgaattggaaatttaaaactgtttatagctttatctcttgaaaagtgagatgttttcattgaaaacgcgaaaaaactacaaaaaactgtaaaaacaaataaatttttaaaccaattccagtaatggtttaaacgtcagtcctttagaattttaactcctcggaatgccgtaaccatctgacgcctccctcaaatctctccaaaaataaattctgaatttgcttaggcagccaaaacacagcccacagggaatataatatcctatatttgtggcctcggagcaagtgttggatacgagcgaatagagcgagtattcaacatgccgcgactaaagtcacaaatataggatattatattccctgtgggcgtctcctttgccacacaaatcagaattcaatggaaaagttccctcatttctgatatactaatacaatgttgataaagtaaaaatttattttgggaggtttaatcatgagcttaaatacaggaatgaaaatgataaaaacggagacagtaacagtggagaatgcagccaagactttaggcagcggcagtctcttagtatatggaactccagcaatgcttttattagtagaaaagacagccgttgcgctcttagacggacatctcgatgagggaatgacaacggttggaacgaatttaaatgtagatcatgtttctgcaagcccaattggctgtgaagtaagctgtgaagtaacgcttacagaaattgacagaaagaagcttgtttttgctgttgaagtgaaagatccagcaggagtgattggtaaaggaacacacgagagattcattgtggatgcagagaagttccagaataaagcgaatggaaagtttgataaataatggcggcgacaggaaagaataatcagggaaaaaatgactcaaaaaggaataatctgaaaaagaatgccacggattttaaggaaaagatatcgaacggtgagccaatgcgtctaaataagttccttagtgatgcaggtgtgtgttcaagaagacaagcagaccgctatgtggaacagggacgtattttggttgacggagagccggcgcagatgggtcagaaagtgcatgctggacaggatatccgtgtggatggcaagcgtgtcagtgtgagtcgtaaacagattgttcttgcggtgaataagccaaaaggcattgtctgtacgacagagaagcgagagaaagataatatcgttgattttattggctatcctgagaggatttatccggtgggacgactggataaagattccgagggtcttattttgatgaccaatgacggagagttgatgaatgagattttgaaggcgagaaattatcacgaaaaggaatatgaggtgacaattaatcgtccagtaacaaatgtgttcttaaagcaaatgagtgagggtgtggagattctcgatacggtgacacgtccatgcaaagtaaaaagaacgggcgtgtatacatttcgcattattctcacgcagggcttaaatcgccagattcgtcgtatgtgtgaggcatgtggttaccgtgtaagagagttaaagcgtcttcgtattatgaatattcatctgggaagtctgccgacaggaaagtatcgggagattaccggggaggagctttctaagcttgaaaaacttgctggaagaaaaccgggaggagtttatcatggataagcaggcgagaatgaagaaacttgtagaagtgctgaatcaggcttctaaggcatactatcaggaagaccgggaattattttccaataaagaatacgacgaattatatgatgaattacaggcattagaggcagagactggtatcgtgatgagccagagtcctacacaaaatgtcggttatgaagtactcagtgagctggaaaaagagacacacgaaagcccgatgctctctcttgataagacaaagagtccagaagcattaagagactggcttggtgaaaaagaaggccttctttcctggaaaatggatggacttacggtggtgctgacttatcgtgatggcgttttgcaaaaggcagttacacgaggaaatggtgttgtaggcgaggttattaccaataatgccagagtatttaaaaatcttccggcaaagattccatttgcaggtgaggttgttctgcgtggtgaggcggttattaaatattcggattttaaaaagattaacgaaggcatcgaggacgtggatgcccgctataagaaccctcgtaatttatgcagcggttctgtccgccagcttaacaacgaagtgaccgcaaagagaaatgtctttttctttgcatttgcccttgtaaaagcagaaggaagagaactggagaattctgtggaaagcaatatgctctgggtacagaatcttggatttgagattgtaccatataagagggtagacagagagaatattatgggggagattcagaacttttccgaaaagattgtggaaaatgattttccatctgacggacttgttcttatttatgatgatatcgcttatggaatttctcttggaagaacagcgaagttcccgcgaaattcgattgcctttaaatgggcagacgaagaagcagagaccaggcttttacacattgaatggagtccgtcaagaaccggtcttattaatccgattgccgtgtttgagccagtagagcttgagggaacaacggtaagccgtgcaagtctccataatatcagtattatggaaggattagaacttggtgaaaatgaccatatcaaggtctataaagccaatatgattatcccgcagattgcggagaatcttaccaaaagcggtacctgccagccgatagagcattgcccggcctgtggtggtgcgacagaagttcgcatagagaataatgtcaagacactttattgtgtaaatccatattgcagtgcaaaaaaagtgaagctcttttctcattatgtaagccgtgatgcgatgaatatcgacggcttatctgaagcaacattgatgaaaatgattgagcagggatttttatccgaattaaatgatttgtacaacttagaacagtataaagaacaaatcattgctatggacggatacggcgagaagtcgtataataatctgatgcagtctattgaaaaatcaagggatacacagttgttccgtttcgtttatggaatcggaatcttaaatgtcggaagttcaaatgccaggcttttatgccgtcattttggaaactctttagaaaatctccgcggagcatccgtagaagaaatgacacagattgacggaatcggtgaagtgattgcaacaagcgtacacgactattttgagaacgaacacaatcagaagcttcttgaaaaacttctgccatatttacattttgaagaggaaaatgtatcggcaggaggcgagcaggaacagagccttttagacaagacatttgttattaccggaacagtagagcattttgcaaaccgaaaagaactaaaggaaaaaatcgaaagtctcggtggtaaagtaacaggttccgtttctaaaaagacagattatcttatcaataatgacaacatgtcttcttcaagcaaaaacaaaaaggcaaaagaactcggaatccctgtgattacagaagaagaatttctttcaatgattgaataaaatgcttatatattatttagaaaagagatgaaaatacatgccaatcagaataaatgctgatttgccagcaaaaaaaatactggaacatgaaaatattttcgtaatggactacgagcgttccttaaaacaggatattcgtccattgaaaatcattatcatgaacctgatgcctaccaaacaggcaacggagcttcagcttttaaggagtctttctaacacgccgttacaggtagacatcactttcttaaaaacagaaacacacgatgcacagaatgaatcccaaacccatatggaaacattctataccattttcccggaaatcaagcagcagtactttgatggacttatcattaccggcgcaccagtagaaactctcgattttgaggaagtagactactggccggaactcgtagaaatcatggaatggtcaaaaacacatgtaacatcgacctttcatatctgctgggcagcacaggcaggcctttactatcattacggtgtgagaaaagaactgttagacgaaaagattttcggaatcttccagcatcacactatacatagaaagaccccgctgattcgtggatttgatgatgtgttcaatgcacctcactccagacattcacagattgtaagagaggacgtagaaaagaatccggaacttacaattcttgcagactccgaagaagcaggtccattcatcatcatagcaaaagaaggacgtcaaatctttgtcacaggacatccagaatatgatgtactgacccttgatggcgaatacaaacgtgatcttgctaaaggaatggacaatgttccatttccaaatcgctactacaaagacgataaaccagaactcggaccggtgaagtcgtggagatgccatgcgaatacgttgtataccaactggctgaattactatgtatatcagatgactacctatgacccaatggagattcagaacctcaaataactaattctgatttgccgcaggcaagtagagacgctccccaagagagaagataccctatatttgtgactctatcacttgcgggttgaatgctcgcttatacgcgctcgcattcaatcctcgttctaaggccacaaatatagggtatcttctctcttggggagctgtttcttggttgctggagcaaaagtagaatttattttttgataaattattttaggttcttgaagaagaaggggaagaaagctggaggtattggcgatagaaaaaggtttagagtagatgaattttgggaaaagattggattaatagagacatagtggaatatagagccttttaaatatcgaagcacagtagaatacaaattcagctaatcaaaacttgaaaacaatagaaaaataaaaaataacctatttcatctctctccccctgactctttttcattttctagaaagtgtctatttagtttgaaaaattaaaagccatctacttcatttccaaccccaccgactctttttttatatacaaaatctatccaaagtcagctcccgaaaagataaataagccatatctgtggcctcggagcaaaggttggatgcgagcgttcaagcgaacattcaacctgccgcgactaaagtcacagatatggcttatttatcttttcgggagcgtcccgttgaattcatcaaaaaagagccggacgataagccgggttatgtcatgaatgatcatctgtctaattctgctgttgccagcagcttctagcgacccacctgaaaacaatccgggccagattatcgttttacattcggtcttgcttcgggtgaggtttacatggcattctctgttaccagagaatcggtgggctcttaccccgcctttccacccttactggcataagccagcggtatatctctgttgcactatctttggagtcacctccaccggacgttatccggcaccctgccctgtgaagcccggactttcctcttcccagacctttcggtaactaagggaagcgatcatttatccgactcttaaaaacaatataagatgcaaaagcatcgttcatcattctagcaaataaggtgaaaaatgtcaaggtaagaagtttgtaaggacttttatattcattttatgatagaatataaaacaaaaaaagacgtgaaggaagggtaaagatatggaaaagaatgctagtattctcgtagtagatgatgataaagagattgcggatcttgtggagatttatctggtgaatgatggatatcaggtattgaaagcttcggatggggagcagtgtttacagacattgaaggaacatccggaagtccgtatgcttattctcgatattatgatgccgggaattgatggattagaagtctgccgtgagataagaaagacaagcaatatcccgattcttattttgtcagcgaaggcagaagatatggataagattgtcggatttggaacgggagcggatgattatcttacgaaaccgttccatccattagaacttcttgcgagagtgaagtctcagatgaagcgttacacaacaattcagttaggggaagaacagcagccagccagtaaggatgagattgagattcaggatcttacgattaacaaggcggcccatgtagtgaagaagaacggcaaggaagttgcactgactccgattgaatttgatattttatatttattagcctcaaacagagacagagtattcagcactgatgaaatctttgaaaaggtttggaacgagaaggtatacgaagtaaataatactgttatggttcatatacgaagactgcgtgagaagatagaagataactcccgaagcccaaagattttaaaaactgtatgggggtaggttacaaaattgaaggttaaacgatttaaaagcttccgttttaagatggtcatgtacatgtttttcagcctgattgctacctttataacggaaggtcttatatttatgggaatctatttatatgagacggagattatagccggtgaatataagaaggtgtggggagcatccgggcagggaaaaatgtcctttggcacatttacaatgtcacagtcgatagcactggatgcctgggtcatcgctatatttacgatattgcttctgattatttattttattctcatatcaaataagtttgtaacgtatgtaagagaaattatcagcggtgtggaacgtatgaagtctggtgatttgatggaggagattcctgtccgtggagaggatgaattttcagaaatcgcagcgtctattaacgagatgcgtcataatctttatgagacgatggaagcacaaaaggcagtggaaaagacgaaggacgaattgattacgaatgtagcacatgatcttcgtacgccgcttacttcaatacttggttatctggatctgctgacacagggagattttcttacggaagaacaaaaacagaagtatctcggcattgtatcttcaaaggcaaagcagttagaaactttggttaaggatttatttgattatacaagatatgacaggaataaggtcaaaataaagaaggagattcttgatttgaatctttttgtgcctcagttagttgatgaattttatccaagcttcatggaccatcaattggaatgccgtactgatttttatgaggggcattgaatattgaggggaatggcgagctgcttgcaagagcgattggtaatctgatttcgaatgcgattaaatatggggccgatggaaagctggtagaagtgcataccggtttaaaagataagaaggcatttgtggcaattgtcaattacggaaagattattccggcaaaagacctggacaagatttttgataagttttacagggtggaaaactcaagatcattaaagactggaggtacaggacttgggctggcaatagcaaagaacattatcaaccttcatgagggaaatatctgggcgaccagcgatgagtcaggaaccagattccagatagaacttccggttgtacaggctcatatgccaaataccggaaaataatagcaaagatacgaggaatacaaaatgattaatgatttgttccgtacttacaaaaaaattatattactgcttcttgtactgctttgttcggttgttttctggttctatggctgtcggcaccaacagcgtagtcagagtgaagtagtagagtggaataaaaagacaataaaagggacgaatggctattgttataagtttaagacgagtaattgtacgggaacagtaacttttggggcggcaggttatgttgccaaagataaggagatgccggttactttagatatctttgctgcagagaaagattttaccggggtaatgaaagtcactcttccgggagaaaatggcaagggaattgcctaccagtctgcagtgaaatgtaaggcaggagagaaggaaaagattgttttaaatgttccgcaacttggtaatccttctgcgatttgttttgaaattatggattcttttggtgttacggaattgtcagaagatgtctctttttctgatgcgaagaatcggaacggagcattttcagaacaggcggagaatctcattggtgttttgagtggacagtcaaaggagttgtcttatttaaacagtcttaaaataggagaagaatcggacgaagagtcagtgaaggtggtctgctattcaaaaaatagttttccacagacagaagaagagtttcaggggttagatggaatgatcattgattcttttgatacgaaaagtttgtctggaaaacaaaaaagtgctttaaaaagctggttgaagtcaggcgggaaactactgattgccgggggcggccagcagatagattcttttgaggggctggaaaagacatttggaattatacaggaagatgtcgtcgtttctgaactttatttggcagatgcggataatacagtacaggaattgccgattcttatgagtaatcttcagctttcacaaaaatatgaatgggaagcttacggggatttcgaaccggaaataggttatactgcagcagtagggagcggaaagatttcaatccttcgttttagcctgacaaattctgcatttttacaatggagtgtgagagataaagcagcagtagagattctttctcattttatgggaaaagatgaagataccgaaagcagcgatacgagtctttggtatgtaaaaaaggcattatatgcatttatgaagtcacagcttccgaatacgtttttttacggggtattttttattttctatattttgctgatggtaaccattgcatattattatttgtgtaaaatcaaaaaaagggaatacatctggattatagttcctgtacttgcattggtttttaccgttggattatttatccgttccaggggaatgaaaagctctggcgatagctatttttccgcgctgcgtgtgacggacagtgagaaggagcaggaaaatatttattttctctatcaaaatgatgagggagtagagggcaatgtgaattttctttcgacaattacttccgtcataccgatggattataattaccggacgattgtaggaaaaaatataaaaacttccggagaagatattacgattaataatacacaaaaaggctttgatgttgcctttgaagagagtgtgccaggaacttcaagaattttgaaattgtcaggcaatacaaaaagcgcctcggaaaaggaagtatttacgcaggatatttttacaacgtatacaagtttttatggcaatatcacgaatacctcttcgaataatttttccagagttattttaattcggggaatcagtatgcgattcttaaaagtgtaaaagcaggggaaaaggcgtctgtttctaaagatatggtgaagtgctggaatcattttgatgaagagaattctgcttttggtacagaaaatgaaaatacagttacaggaaatattatggaatatctccaacagacttacatgaatacgcaaaagtcaaaagaagaacttttagttgtcggtattacaagtgagaatgactttaagttgttttctgatgataatgttttgaaaaatcatgtgacggtgatgattaatcattttacgttagaagaagaaaccggagatcatattttaaatatcaatatgtcctgtctgaaacaggaaggagaaggactggctatagaggaagatacgttagaggagaataagacagaagtcagttatgtctttgacaaagaagaaatagaagcactggcaagaaacaaggataatttcacaggaaagatatatgcgtataattacagtaccggacaaagagacaggattttatcatcgacagaatcttatataacaggagaaagcctgaacagttacttgtcaggagatggagaaatgcggattacttataagatggatgcgtcggatgagtatggaccggcaccggtgctgtcactgatttataagaagcagtaaagggggagaagaatgctggattttcaaaatatttctattcagagaaaagggaaaaaagtattagatgatttcagtctgaaagccccggatggagtgatactcgccttactgggtgaggataaagagggaaagtccacgctgcttaaggctgcttctggtggggaaaagccggaaacaggagacatttatatagatggtatctctatttatgaaacaggagaaaatgcgtactgcaattttggctatatgtctaaagaatatggcttttacagtctgttaaaggtagaagaatattacgaattgttcctggcactgtataaggtaggaggacgatatcggagccggaggattgaggaagttctggaacttcttgatatgaaagaatatgagggagcattcatcggtgaactgccggcagaaaccttaccgtttttatatttgggaaaggccattttacaggaaccagaatggctgttgatggacgaaccgtttgataatatgagtgtgacagcaaggagaaagatgataggaattttgctcaccctccatgaaaaagggacttccatcattttaaatactccgatgtatccagaaatgatgggattcattacggatgttcttgttatggagtctggaaagaatctgacctttggtccggtagaagaagtgtacgcagaggcattatgtaaaagtcctgtacgaatgcatatcttagctcagatggagaaggcactggaagttttgaaagagaatcctcttgttgaccgggttacggtagatggggatgatgtgattttccgatttaacggaggagaaaaggaagaagcagaacttcttaccgatttagttgcatctggtgcactgattcataattatatgcgggaccaggcggacatagaagaaattttccggaggtagtagttatgtggaatccctttttaaaagtagaatggctgaaagaaggaagaaatatacggcttcccatgatgctcattttttataatgcgatactggcatttatcacaattttatttatgttttttaatgcagagtcctttcaggaaggctattcctacgatacttctgcatatctgtatcagtttttaattataagcacgattcagattggaatgatatttgtactcatgcctttttcggtatggggattttattcaacagatagagaaaaacatatgttagaagaatttgtaatgattccaggttcttctaagcaatttattattgccagagtttcggtgattattgccgtatatatgatgttatttatatctagcctgcctatcatttccctgtcttgtatatacagcggcctgccgtggagaaagattatccgtcttgggattatgctgtttatctgtacattctggagtgcttccgtttccattttttcctttagttattgtaaaaaaggaatctgggcatttgcacaaaatacagtcattgaggcagtgttcattctgggaacgattttaggaacagaaattatgcgaacgatatctatctctgtatcaggaatggataatctggcaccaatcacgacaagtctgtgcctgctcttaagcctgataaatccgctggcagcatatatgggatattacgggaatattacgggagatagcggactgatgaatctttattgcgggcgaatcggcattgacagttcaacccaggctttctccttccttttttataaggcagcgagtattatgtgcatccttatgggaattgcctttttggctttggcagtctggcagatggaaaagcaggcaagagagtagtcagacagataaaaatgcaggtataagagtagccgccagccaataattatttttaaattattgtgaaaaataaagaaaaatagtccgaatttttttgtaaaaaacagaaaaaagaataaatgagagtgaaaacctgcaaattatgcgtatacaaaaagattttcgtatgctataatgatggcgtttatttgatttaaaaaccgaaatgacgtgcgccaggcgcacaaccgcacacgggaggtagacatggacttaatttataaaagtacaagaaataatcaggagacagcaacagcttccgaagctattttaaaaggtttagccggagaaggaggactttttgttccttcctatattccaaagcttgataaatctttagaagaactttccaagatgagttatcaggaagttgcttatgaagttatgaagcttttcatgactgattttacagaagaagagttaaaacattgtattaacagtgcttacgataaaaagtttgacacagagaatattgcagaattagtgaagaaagatgatgcatattatctggagctgttccacggagcaactatcgcatttaaggatatggcactttctatcttgccttatttaatgacaacaagcgcaaagaagaatcaggtaaagaatgaaatcgtcattcttacagcaacatccggagataccggaaaggcggcattagcaggatttgctgatgtaccaggaacaaagattatcgtattttatccaaagcatggtgtaagccctattcaggaaaaacagatggtaacacagcgtggagagaatacatacgttatcggaatcgaaggtaacttcgatgatgcacagacaggagtaaagaagatgttctctgacgcagcactcgcagaagaaatgaacgaagcaggataccagttctcctccgcaaactctatcaacatcggacgtcttgttccacaggttgtttactatgtatacagctatgctacattattagcccgcggagaaatctctgacggagagcagattaacgtagttgttccaacaggaaactttggtaacatcttagcagcatcctacgcaaaacagatgggagtaccaatcgcaaagttaatctgtgcatctaacgagaataaagtactctttgacttcttcacaacaggatgctacgacagaaacagagactttatcctcacaacatctccatcaatggacatcttaatctccagtaacttagagcgtctcatttatcagactgcgggaagagatgccgagaagaacaatgagttcatgaaagaactgaatacaaacggtgtttatacaattaccgatgacatgaaagaacagatgaaagacttctacgggaactatgcaacagaagaagagacagcacagaccatcaaagaagtttacaataaagcagattacatcattgatacccacacagcggtagcagcatctgtttacaaaaaatatgaaaaagaaacaggcgataccacaaaaacggttatcgcatctacagcaagcccatataaatttacaagaagcgtcatgaatgcgattgattcttcttatgacagtaagacagattttgaactcattgatgaattagagaaactgtctggtgtcaaagtaccacaggcaatcgaagatatcagaagtgcagcagttcttcatgatactgtatgcgaaacggaagatatgtgcaaagaagtgaaaaagattctgaacattaaatagtaatttgccgcaggcaaagggagacaccctcagtaagataaatggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaagggcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggtagagcaatcatgactaaaggcagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatggactgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaagaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatctggtccaacttaaagagccggtataatggctgtaccagagcctcaaacaacccagcatttattgcagaaaacattcttaatagagaatttaaggcggaacaccttaatgagaaatgggttaccgatgtaacggaattcaagtatggaaataccttagacagtgtacataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccaaaacagaccatatttgtgactttagtcgctgcaggttgaatgttcgcttatgcgctcgcatccaacctttgctccgaggccataaatatggtctgtttatcttactgagggttgtgctttggctgggaagatgccgctatagagaaagtgactgtcggattgctcaaagaataaaaagcactattggaagaaattcttctttttgaaatctgaaaattgtagttttcaaagattttcgtctattcccctcactttttgttgacaaagctttctttttggagtattctattgataacatgagattataataggttgagtgcgctactcgcaatggaggtggagctatgctattagttactacagaaagaattgcaggaagagaaatcgagccgttaggtattgtagaaggttcttctgtccaaacagttcatgcaggtaaggatatcatgaacagtttaaaaacgttagtgggtggagagcttacttcatacacggagatgatggagaaagccagaacgcttgcaatagataagatggtaaggaacgcagagcagatgggtgcagatgcagtagtatgtgtgcgttattcctctagcgaagtaatgcagggagctgctgaggttttagtatatggcacagcagtcagactgatttgacggatatataagcaggatggcagtagataatagccgtccgcagtcggagaattctgccgggcaggattctttttcttcgttagcttttgattttatttttttatattgaaagtatttggagagaatcaggaaacagtcagaaagtttagttataattagagttgggagaacagaatggaagatataagaatagtcttttcgaacatcatggagaagcttctcaaacaggcacataagaataaaaatgtgttagagtataaggagattaacgatgcatttaagaatattgagttaactccggagaagtttgagtggattcttgattattttgaaaaacagggcgttgatgttttaaataccaacgaagaagatgacggtgatgataattttatagatgatgatacagaagaagttgagatcattgatgatgctgatattcttgaaggtgtcagcttagaagatccagttcgtatgtatttaaaagagattggtaatattcctctgcttacagcagaagaggaagtatttctggcacagcgtatcgaaaagggagatgagcaggcgagaaagcagcttattgaggcaaacctccgacttgtagtaagtattgccaagaagtatgttggaagaggaatgtctttccttgatcttattcaggaaggtaacatgggtctgatgaaggccgttgagaagtttgattataagaagggtaataagttcagtacctactctacctggtggattcgtcaggcaatcacaagaggtatcgccgatacagcgaagacaatccgtgtaccagtacatatggtagagacaatcaacaagacacttcgtacttcaagaatgttacttcaggaactcggaagagaacctaccaatgaagagattgccaagaagatgaatatgccggttgccaagattgatgagattttaaagacatccagagatcccgtatctttagatacaccaatcggtgaggaagaggacagccagttaggtgatttcattgaggatgaatctcttctttctccagtagattctgcatctttttccatgcttaaagaagagcttgaagaggcaatggcttctcttacagaaagagagcgcaacgttattaaacttcgttttggacttgatgatggtaagacaagaactcttgaggaagttggtaaggaatttaacgtaacaagagagcgtatcagacagattgaggcgaaggcacttcgtaaacttcgtcatccaagcagaagcagaaagcttaaggatttccttgagtaatttattacggatttctacaaaagaataactgtatattagagcatttttcaaacacgctctaggaataagaaggtcataagagaacgtttgatttcccatgtggcgggcaatcaaaaatttccttgtactgcttgttgccaaaagataaataattgattacaataatgggaagactaaggaacttaggattcccattttgctttatggaggtttttatgaaagatggctttttaaaagttggtgtggcatctgttgatgtagaggttgccaatccgattcacaataaagaaaaggtaatggaagtaataaagaaggcagataagaatggcgtaaagcttttagtttttccggaacttgttcttactgcgtacacttgtaatgatctttttttacaaaagacgttacttgatgaggcaaagaatcagctttttgctattttagaggagacaaaaggacaggatatggtaatcgtcttaggtcttccattaacagtgaatcataagctttataactgtgcggtatttgcacagggcggtaaaatattaggcgttgtgccaaaacattatctgccaaactattcagaattttatgaggcaagacattttgctccgggagaagaggaagtaagaaagattcgtcttggtggtaaggatgtaccttttgggatgaatcttttattttgctgtgagaacatggaagaattggtgattggatgtgaaatctgtgaggatttatggtgcccactgccaccatctacccatcatgcattagcaggggcaactgtaatctgtaatccgtcagcaagtgatgagacaacgacaaaagatacttaccgccgtaatcttgtatcccagcagtctgctcgtctagtatgcgcttatctttattcctgtgccggtgagggagagtccacacaggatttagtgtatagtgggcataacatgattgcagagtatggttctattttgaaagaatcaagaagattccagaatagttatatcgagacagagattgacttgcaaagattagaggcagaccgacgaagaatgacaacttttgtgacagaaggcgcagataaaaattatgagagagtttatttccggctgaaagaagaacgaacagaactcagccgttattttgagcgtacaccgttcattccttctaataagattgacagagaaaagcgttgtgacgagattcttaccattcaggcaatgggtctgaaaaagcgtctggcacatacccactgtcagtcggcagttgtcggaatcagtggaggtcttgattccactcttgcagtattagtaacggcaagagcatttgatatgttgaagattccaagagagaatattgtctgtgtgacaatgccttgttttggaacaacagacagaacgtactccaatgcagtaacgctcacaaagaagcttggcgcaagcctgcgtgaaatccgtattaataaagcggtagagcagcatttttcagatattggacatgacccggaaattcataatgtaacatatgagaattctcaggcgcgtgagagaacacagattttgatggatattgccaatcagacaaatggaatggttattggaacgggagatatgtcagagctggcgcttggctgggcaacctataatggagatcatatgtccatgtatgctgtgaactgttctgtaccaaaaactttggtaagacatctggtacgttattatgcggatacgagcgaggaacaggaattaaaagaggtactgcttgacattttagatacaccggtaagccctgaattacttccaccggtagacggtgttatttcccagaaaacagaagatttggtgggcccttatgaactgcatgatttcttcttatattatatgcttcgttttggattccatccagagaaaatcttccgtctgaccagacaggcatttggagaagaatatgatgttgcaacctgttataaatggcttcgtacgttctgctggcgtttctttgcacagcattttaagagatcctgcctcccggatggaccaaaggttggttctattgcggtttcaccgagaggggatttgcgaatgccaagtgatgcaagttctgctgtgtggatgagtgaattagatgagttaaaagagaagctggggctttaaaaagagtgatatcagtattttatgtaatagaaaatatacagtaaattgcgacgcacatcttgcagaaagcatttttcaaacacgctctaagacttggctttggaaagtgcatttttgatagcctgctgtaagatcaggccagtatatttattttctgcatttagttttagatcatcaattgaagaaatctgctcaagctgcgcattgatttcttcaagagatggctcgaggagcggatacatagcacttacactgtcagaaagatggttcaaactgacggaggtaatgtggtctgcatcaacggaaactgccacatctaatgtattatcgccaagagtaatcgtagaagtatagactccgggcgtgtagacacctgcgctggttttggtgcttttttcttctggagcaaacataaagattagaagaagaatcagtatgatacctaaacagacgaaaagagcagtataaataagttcttttgcttttacgacaacgatttttgtttttgcactcaaaaaaaacagtccttccgattcatatttattaaagtgtattctgaaaataaaaatatatgatacattagagtgtgtttgaaacacactttagggtattttttaaatacgctctgagcatatttaaatttatagcctgcacaatattgaatcgattgaggaagaaaggagaagaagatgcttgaaggacagacttttatagaagtatttccagactataccgttccagataatttaaagtatgttttgtccaatgcgattgtttcgaaggttgtcatgaaacagcagacaagacagctggttgttcatttgagaagtgaacatattattcctagaaaagtattgaataaagttgcctacgatatgaaaaaagagctgtttggaaagacttctgtgtttatttcttttgatgatacgtatgaactgtcttcagcctatacgttagagagcataacgaatgattactggaatagtattcttcatgaagtgaaaaaaatgggccgggtggagtatagtcttctttcgaatggagagtggggatttgaaggaaacatcatgacgatccttttagaagattctttccttgcaagggataaatcccgtgttttaaaagaatatcttgaacatcttttttctcatcgctttggaaaggaaattcaggtaggatttgactttaccgatgatgcaaaacaggcattttataaggcgagaaaccataagctgaatctggaagtagatatggtcatgagtcagatcaaaaaggtggaaagtgagaaaaaagattctgatgcggaagatggagaaggttcaaaagaagagaaaaaaccgcaacgaagctattctgggaatttctttgaggagcgggcaagaagacaggaatttagtcagagacgccgctcaaaggacccagatgttatttacggtaaggattgtgatggagaagttgtgccattagaagaaattgtcgatgagatcggacaggttgttgtccgcgggcagattcttaaaatggaacttcgagaaatccgaagagagcgtacgattgtaagtttccatattacagactttaccgatacgattgttgggaagatttttattgccaatgaccagctgccggaatttttggatttatttgaaaagggaaagttctataaagtaaagggaatgcctcgtatggatacatttgaacacgacctgaccctttcctcaatttctggaattaaaccgattcctgactttacagaaaagcgaatggataagagcttggaaaagcgtgtagagctgcatcttcataccgtaatgagtgatttagacagcgtggttgacattaaaaaggttatcaatcaggcaaaagcctgggggcatccggcaatggcaatcacagatcatggagttttgcaggcattcccgattgcgaatcattgtattacgatggacgaaccgtttaagatcatttacggagtggaaggttattttgtaaatgatttaaagaagcttgtcacgaatgataaaggacagacattattagatgattatgttgtatttgatttggaaacaacaggttttagcccgattcatgatgcgattatcgaaattggtgccgttaaggtaagcaaggggaaaataagtgaccattacagtgtatttgtcaatccgcagcgcccgattccacttcggattacagaacttacaagcattgatgactcaatggttgcagatgcaaagtcaatagaagaaatcctgccggaattcctctctttttgtgaggggtgcagtctggttgcacataatgcagagtttgatgtgagctttatcgaagagaatgcaaaaagacagggatttgaaacagattttacggtacttgatacggtacagatggcaaggctgcttcttacggatttgaataagtttaagttaaatacagtatgtaaacgattgaatatcaagcaggaacatcatcacagggcagtcgatgatgcaagagtaacggcagaggtgtttcttcgttttgtggaaatgcttgaagagcaagacgtacacacacttgccaaattaaatgatatgggagcgatgtcaccggatctgattaagaaagcgccgtcctatcacggcattattcttgtaaagaatgagacaggccgtattaatttaaacagactggtatcggcctcacatctggactattttaaccgccgtccgagaatgccggaaagcttgattcaaaagtacagggaaggacttattttagggtctgcctgtgaggcaggagagctgtttcaggcagttatcagggggaaaagtgaagaggaattagcagaactggtccgtttttatgactacctcgaaattcagccaatcggtaacaatatgttcatgcttgaaagtgacaggtacgaagcgaaaacagttgaagatttacagaattataaccgtaagattgtggaacttggcgaaagatatcacaaaccggttgttgcgacctgtgatgttcatttcttaaatccagaagatgaacagtatcgtcgaattctcatggcaggaaagggattttcagatgcggataatcaggcaccgctgtattttagaacgacggaggaaatgcttgaggagtttgcctatctcggagaagcaaaggcaaaggaagttgttatcaccaacacaaataagattgctgatatgatcgaaaagatttcgccggtacatcctgataaatgtcctccggttattccaaagtctgatgagacattaacaaaaatctgttacgataaagcccatgagatttatgggccggatctgccggatattgtagaggagagactacaaagagaattgaattctattatatccaatggatttgccgtaatgtacattatcgcacagaagctggtgtgggattcgaatgaccatggatatctggtaggttcgcgaggttccgtaggatcttcttttgtagcgacaatggcaggtattacggaagttaaccctttgtcagcgcattatatttgtcccaaatgtcattatgtagattttgactctgatgcagtaagaccatattcgaaaaaaggtatgtctggctgtgatatgccggatagggactgtccggtctgcggcacaccgttacaaaaggaaggacatgatattccatttgagacattccttggatttaagggaaataaagagccggatattgacttgaatttctctggagaatatcagtcaaaagcgcataaatatgtagaagttattttcggagagggaaaggcattccgggcaggaaccatcggtacccttgcagaaaagacagcatatggttatgtgtacaaatattttgaagaaagagatattcataaaagaagatgtgagatggagcgtttggcggaaggctgtacgggtgtaaagcgaaccacaggccagcatccgggtggaattatcgtagtacctcatgaacatgagatttatgaatttaccgcaatccagcatccggcaaatgatgtgaatacagatattattacaacacattttgagtaccattctattgaccacaacttgttaaaacttgatattctcggccatgatgatcccactatgattcggcgattagaggacttaacaggaatggatgcgacaacaattcctcttgatgatccagaagttatgtctcttttccacagtaccgatattcttggtatcacaccagaagatattggcggaattgagatgggttctcttggcgtaccggagtttggtaccgagtttgttatgcagatgttaaaagatacaaatccaaagtgtttctctgaccttgttcgtatttctggcctgtcccacggtacagacgtatggcttggaaatgcacagacattgattgaagagggaaaagcagagatttccacggcaatttgttgtcgagacgatattatgacctatcttatcaatatgggacttgataaagaacagtcttttaccatcatggaatctgttcgtaaaggaaagggattaaaaccagagtgggaagaagagatgacatcccacggcgtgccagactggtacatctggtcttgtaagaagattaaatatatgttcccgaaagcgcatgcagcggcatatgttatgatgggctggcgtgtggcatggtttaaagtacataagccattagcttattatgcagcctactttggtatccgtgcctcagcgttttcctatgagattatgtgccggggaaaagaacgtcttgacattgcacttacggaacttttaaaaacaccgaaggatcagcagacgaaaaaggatcaggatacgattcgtgatggaagaattgcacaggaaatgtacgcaagaggatttgagtttatgccgattgatatttataaggcaaaagcaagagaatgtcagattattgatggtaagatcatgccgccgctttccagtgtggagggtcttggagataaggcctgtgagcaggtagaagaggcagcgaaacatggtccgtttacctcacttgaaaactttagaaatcaggcgaaagtcagtaagacgaacgtagataagatggtggaacttggaatacttacaggacttccggaaactgaccagcttacatttgatttctttatggcgcagagccaggtataatgagagacagagaaaaggagaaaagcatgagttatattaaaaacgcagatattcagggaaatgcatgggtagcaccgggagcctgtgtagtaggaaatgtcacattaggagatgaaagttctgtatggtataatgcggtacttcgcggagatatggcaccgattgttgtagggtgtggttccaacgtccaggatggcaccgttgttcacgcagataatggcttcccatgtaaaatcgggaatggaacatctattggtcataatgcgattattcatggatgcacaatcgggaataataccgtcattggaatgggtgcgattattatgaatggcgcgcaggttggctccgactgtattattggagcaggaagccttgtcacacagggaacggtaattccggacggaatgctggcatttggttctccggcaaaggtaatccgcccacttactgatgcagagaaaaaggagaatcagacaaacggtatcagctacatgctgatgaaaaatgtacaaaaagggtgaaaaaacttgaaatatagataggggttggattataataaggcgaatatgacttttggcaaactagaaaggagaacttttaattttatgtcggatactacaaatacaagaaaatataaaggctatgagttagatcagacaacttcccatcgccgcaatcagaatcggccgtggttctggaaggtattgggtattagcttattgcttacggtgctgattcttgcaggtgttgtttttggacttttgcatagaacgcataagaacgcaaaacacatggaagagattaattctgcaaatacagtcgaggcattacttaaggagcacaagcttgttacaattacagcttcttactctcatttggcagaaggttctgattatacgacaacccgccagattaagaaagataaaaagggaaactatttctcttactttaagaaagaaggttccgatgatgattacaaagaagtaatcagtaataaagaattatatcgttataatgggaagtatacacagtatttcggactggttggaaatgattacgaggaagaatgcgtaaaagcgattgaggacagcattttccagggagatatgaaagatcagattcagaacgaaaaagaacgtgatagtacaatcactttacagcttacgactaaggttcaaagcggagatgattatgatacggaatacggattctctgctggagatacgattgagaaaacgattattattgataaaaagacacagcttattacttctgtagaggagaaatgtggggatgaagttttctatggttatacagtagagtttgacggtgaagaaaagattccacagttctataaggatttaaagaaggaaaaagaaaagagagtatgtactgtttactctgattatgatggagaaaagaatcaggaatatacatttaatcttccaattgatttatactttactgtacttgatcatgatggatataaggtatatgaagatgaggatggaacgaaggagtttacacattatcagatggaagtgcagaatccagattctgatctatccctctatataaaagcagaatcatcaaaataaagagcatctagtcaggtgttacttgacgaaaaggggaggctgccgcgatcatattctgacgcggtagtctttttttatagattgtattttttgaaaaatgctttctgaaaaatatgccacaatttggggcatgcaggttgcagggatatttttaagacactcgctgattgtgtttgaaaaataattcaagaataaaaggggatttgattatgaaaacgagaagattattttatgaagatgtatacattagagagtttgaggccattgtactttcctgtgaggaaagacaggaaggatattatatcattttaaatgaaacagccttttatcctgaaggcggaggacagccagcagataagggaacgattgagggagaagaagttcttgatgtgcagtatgtggatggagaaatctgtcatatcatgaaaaaaccattgaaagcaggggaacaagttgtaggacgaatcaactgggaatggcgttttgaccttatgcagcaacattctggcgaacacattgtcagtggaatgattcatgaaaaatatggttatgaaaatgttggatttcatatgggagaagaagtcattacaattgatttaagcggaatgctgacagaagaacaagtggctgaaattgaacaaaaagtaaatgattatatttggatgaatcaggaggtaaatattttttatccagatgagagacaacgaaaactcattccatatcgaagtaaaaaagaacttacaggagagattcgcctggtagaatttccgggagcagacctttgtgcctgctgtggtcttcatgtgacacatgccagccagattggtctggtcaaaatcctttccagtaagaagtttcgtgacggggttcgtatggaaatgctttcaggaaaacgggcattagaatatctgtcaaaaagtgcggagcaaaacagccaggttgcagtcagactttcggtaaaagaaaaagagacaaaagatgcagtacagagacttcttgatgaagtttataacttaaaaggtgaacttgcagcagaaaagcaaaaacattttgaacagatagctgcttcctgtgtgggaaaagaaaatgtgctgttgattgaaggagatatggaaccagtagaagtaagaaaatgtaccgatgcgattttagatacatgcagcggtgttgcagctttctttgcgggaaatgataaagacggatataaatatgccattggacagagagaaggagatgtccgggaacttgtaaagcaggtgaataaagaactgaacggacgaggaggtggaaaaccattttttgcacagggttctctgaaagcaacgcgaaaacaaatagaaatcttctttgaaaagaaggtaaatttccaataatataaaaaataacctgcaaaagccaggaaagaaagcaaaaagaaatttctttacaattattttcaaatgggctattattttgatgaaaatactttggaaaaagtttaagagaagttcatgttttgcggtggatgcagatatagtcaataaaaagtggcatagatgagaacatacaccggcgaaacagaaaggaaggaattatgtttaagaataaactgaaaagattatgtgcagtaactcttgctggaatgatggttgtgagtgtaagtgcatgttctacaagcaaaagtgcagagaaaaacagcgtttctaaggcagaacaggcatcagaggcaacaacagaggccgcaaaggatgatacgacagcggattacgttgcttctggtgtagagcttccagataattttgaaaatatgatttatccaattgaggctctgatgttacagaattattcaaaaggttatccatactatgcgaatggtgccagtgaagaaaagtcggattctttctggttttctatggcagcactcacttccttaatggagaatgaatctgcttacggagatggaattgagatggattcctactattatcttaaagagaacacatcaaatatgtatgcatctgctctttataatgcatatggaatgggcaacatggaatttccggaaattcctgatggtgataaatatgcgacatatgatgatggcaagcagatgtatggcttcttaaaaggagaggtaagcggtcttgttccatatattacaaactgtgtgaaagatggaagcgattatatcatcacatcacagcttcgagataaagatacagatgaagtaaaaggaacatatgaagtgacgatcaccgcatcttcttttgatggtgatgataactgctttgcctattctgctacagcaatcagacagattggggagacagattctgagaatcagagtacatcttctgaaagtgaagaagcgagtacagacagtacatccgagaatggagacagcacagatgctgattcatctacagacagcacggatgctacagattctaccgacagtacagaaggaatctcacaggatgacgcattaagccaggcaaaagattattatggagaagatgcagaatattcatacaagaagcaagttacagtgggagataaagaatattatgatttttccgtaagtggtgataatgtcagcagcacagatgtattagtatctgtagatggacaggatgtcattggcggaacacagaacgatgatggaagctggtcatttgatcagtaaatggaagcagccgtcaccgtgttaagttagatagtatattgataatataggaactagataataattaaataatataagaaatcaaaaaagaaatctattacacgatgtcttaaggaaagtattatgcctaaatatagctttcacaaatgatatgacacgtgtaatagatttcttttttgatttcaggataagagacttattgagtgaagaaaataagagtaaaggtattgagttttatcctcttacagcaagaagactccgacctctaaggtgggagctgaattgcgtctgctacctacttgatagtgcatcctaattatagtatagtatctttagtcggataataaaaaattgaaatgcagaaaggttcaaacaatcgcaataagcagaggcttaaggtagcaagacttcacgaaaaggtttccaatcaacgaaaagactttttacataagcagtcaagacagataaccaatgcctatgattgcgtatgcatagaagatctggatatgaaagcaatgtcgcggttgctaaattttggggaatctgtttcggataacggctggggaatgttcacaacatttttgagatacaaactggaggagcagggtaagaaacttgtgaaggtgggtagattttttacaagcagccaaacctgttctgtttgtggttacaaaaatgcaaaaacgaaaaatcttgcgataagagagtgggattgtccgcagtgcgggatccatcatgacagagatgtaaatgcggcggtaaatatcagaaatgagggaatgcggctagtaaatacatgaccttaacacaatataacacaaccgtgggacacacggggatagctcgcttatgcttagcacagtagtgttatcgaacgagaaccaaacttgcctaggttgggaagctcccacctctacaggtgggggaggatgtcacaggaaatatgttacagtataattaaaatagctgtataagtagaaagtcgagatattgtagtaagctaattgaaacttttgcagtaaaaggagagggaacaatggacgaagaaagaagaaatggttcgaattgggatgacaaaacgattccattagaggaagaacagactgttccgcttagagagaatagagtgttttcaaatcaagttagaaagccaaaactgaaacatgcatggtcctctaatgaacgatcatcgtacaatcaatcgcagggaaatcgacctccctatgggcaatcacaggattcacaatcatggggtgatccgcacagtcagaatccatatcagcaaggtgggcagaatccgtatagtggcaataataatccatatcaacagagcaatcaaaacccctatggtcggcagccgtatccaccggtgggtcaaaatccctatagccagcagagcaatcaaaatccttataatcatcaaccgtacccacaagggaatttcaatgcctatggttcacagtcatatccacaagggaattccaatgtctatggacaacagtcaaatttacagggagagccaatttcatataatcagccgtcttatatacagactccagtaaaggtgcgttcaaaaatgccatttattatagcaggagcattgattgtaatattatttttaggagggctggcgattgggctgatttcctcaaataaaagtggaacacaggctaataaaaatagtcaaaatgcagaacaaggagattcatctaagattctggtacaaaatggcgactttgatactgtagtaacagtgaaaagcaaagatattgataatattaaactttttaaagaaccgggaggaaagaaaaaagcaggaaaagtacaggaaggagttccctgtgcgctattacaggaaaaaacggtagatggagaaaaatgggcaaaaattgatttttgtaatcgtcagggatggtgtcggatggacagacttcggacaatctttggagagacatgctatttttatgtaaaggaaaatagtaatgaaaatactgtctttgtaaatgagcgagcaatcaaattacatacaggagctggacaggatacagatattgcagctaccgatgttaaatacggaacggaactaaccatatcaaaagtcgaagatggatggggaagaacaaattatcaaaataaggaatgttggattgatatgaatgttgtcggattctatacatcaaaatactggcaagtagaaagatgtgatggaagtaagaatggtatcaagcttcgaaaatcatctacagaagatagcgaacagcttacaactgttccgttatgcacgaaatttcaatcttctgactgcagaaatggatgggcaaggttcacatatggcggaaaaacaggctggttaaaacttcattatgcaacaccatgtggaagtagtaaggggcttagttttagcgaagatgaaaataacttctaagttgccgcatgcgaaggagacgccactagaaaaagaaataacctatatttgtgactttcgtcacggcaggttgaatgtcgcttaaacgctcgcattcaaccattgtttccaggccacaaatataggttgtttttcttaaccagagtttttataatttgcattaacccctcgttgtcgtaagtaaagcgctttttttgttttacatgtgttgtgtttatttatgaaaaataatttttgggaacaagtgtgtattttgataacgttgccaggaaaaaatgaaatgtgataaacatatataaatagtaggaaaatgagaatgggattttttgaaaagtatttaaaatgaaatagaaaaaagatatttttgataatattatcaagaaagcaagtaagaaatagaaataaaactgtaaaaaatttacttaaacaaattgcattttggacaagattattatagaatgaaaaagactatttaaatcacaatctggtagtttatagaaaatataaattttaaatagttagaatgaatgagaaagagacaggaaagatgaagaatcaaaacaacacagcacaaagtgcggaaaagcagagctttctacaaaaaaagaatgtagagatttcttttaagagatatgcgattgacgcgatgggagcgatggctcttggattatttgcgtctctcttaattggaacgattattaagacactggcagagaatgtcggaacaactggcctgatggcagcgctggcagcgattacggatacaggagaattggcagcgaaggttgccggacttagtatgctgaatcggttctgctggattttatggcagattggtaactatgcaacgatggtaaccggtgttgcgatggcggcagcgattggttatgcgttagatgcacctccattggtactgttttctttatgtgcagtcggtcaggcaacgaatacattaggcggctccggtgggccattggctgtattatttgtagcgattattgcctgcgaggcagggaagcttgtctctaaagagacgaagattgatattttagtaactccggcggtaacgattattgttggtgtaggatgtgcgatggtactggcaccgatttttaagacaatttgtgactcgcttggaacatttatcggatgggcaacaaatttacagccattctttatgggaatcattatttctgttgtcgttggtgttgtcctcactctgccgattagttctgcggcaatctgtgcggcagttggtatcagcggcggtgctgtcattgcgggagtagtagatggcagtatttctatggaagtgtggaatggtcttgcacttgcaggaggagcagcaacagtaggctgttgctgtaatatgcttggatttgctgtaatcagctacccggataacggagtaggagggcttgtagcacaggggcttggaacatccatgctacaggtgccaaacctgatgcgtaaacctgttttatggataccgccagtacttacttctgcaatcttaggccccgttgcaacctgtatttttcaacttcgtaataacggagcagcgatttcttccggtatgggaactgccggtttagtaggtccgatcggaatcatcacaggctggtcaaatatgccaaagggatatgcccctggagcctttgactgggtcggcatgattttagtctgctttatactccctgtcgttttaagctgggcgattggaaagttcatgcgaaagaaaggctggattaaagaaggagacttgaaggttgatttaggttagaaagtttgaaaaaatagcttatcgtccatatactatatttgccttcgaaaggagaaaagttctgatacttggtaaatctaatttgttgtattagaaataggcggccgctgtagatatagatattctatcggattgctcaaaaaatgtggaaaagaacccctaaaaaatttgttgaattttgtgactttgtgctgtgggattttgaccatagaaacttcgcattcgtttttgctgccttagagcgtgtttgaaaaatcattcctacaatctgcacgccccaatttgcggtatattttgccttcattcagttgacgtagcccgctacgccgccctcattcaggcgaaatctcccacaaattgtaacgcacatcttgcagaaagcatttttcaaacacgctctagcaggtcgaaaaaagctccagtggaggttttgagagcaagtttctgcttgattgggcaaaatggagcgtttagcacaatggaacaaaatcaataaattttttagggattcttgttgataattcttctggcaatccggctactattcttctcagcagcgtctcccttgcctgcggcaactcagaagttcctaaagtgtttttccaagcgattaagaactccatacaataacgctgcaatcaggcaaagcaatacaatagagagcatcacccagtccattttaaaaacctgtgatccatatatgataagatagccaagaccttctttggcggcgagaaattctccaataacaacaccgattaggcaaaggccaatatcaactttcagaatgcttaaaatcgttggcaggttcatcggcaagatcactttcgtcaggcagtctgcctgactgccatgaagtgttcggatcagctttaatttatccgggtcggtagacataaagcttgtaaaaaggtttaagatacttccgaatatggcaacggatatcgctgttacaataattgttttcatattgttgccaagccatacgataaagataggagccatagcggattttggcaggctgtttaagatgacaaagtaaggctctaatatctcacttagcgtattgttccaccaaaggagaatggcagtgaaaagacttactgcggtaacgagaaaaaagcttgcaaaagtttctgcaagagtgattcctaagtgttttaaaagctggccgttaagaagaagttctttgccagaagcaagcattcgtgaagggctgctaaagatgaacgcattgattattccggcacgagaagtgatttcccagagaataataaaaaatataaataaaaaaagctgaaagaacaggacaaactgcttatgttgtcttgttcttttcatatatagaagctgttcttttgaaatttcattcatcggcttttaactccttccatatctggttaaaatactcctgaaactttgggtggatgcgtgcttcttttgaagaaagttttttgtttgttttaaagtcaattgtgacaatcttacgaatgtggcctggacgttttccgagaacgataatacggtcagcgatactgatggcttcggataaatcatgcgtgacaagcagcgtggtaacgccgctttgacggataatttttgcgatgtcatcggatacatcaaggcgggtctggtaatctagcgcactgaaaggttcatcaaggagaagaaactctggttttaaggcgagagttcgaattagagcagctcgctggcgcatacctccggaaagttctcttggataggaggatgcaaagtcagcaattccatattgacgcatcagtttttgtacatattcgagatttttttcggtaagccggtgttgtatttcaagacctaaaatgatatttttatatatagttctatgctctaataaatggtctttttgcagcatgtagccgatagcgggtgttttattacaggctggatagaggagactgccggtttcaatgggaatcagtccggcaatcagctctaaaagtgtagattttccacagccggatgggcctacaattgctgcaaattcaccagggaaaaggtcaaaatgaatgtctcttaatgccggtgtttcaccactatttgtatggtaagtgtgtgaaagactgcggacggacagaaaaggttttgtttgtggcaaagctgttcattccttttttcgcgaggtataatttaacatatgcaaaggaggaaccaaagtgatatatttcatgatcatagcatcaataattgtggcagataagatattaaaagaatattttaaaagttcatttcagggaaaacatcgggaagtacggacaaaaggtaatggatttggagtaagaaaggaagtaggaaagcaaaaggtaaaggaaaatttgtttagaaagaaagaacaaaataaagcagaattgaaacagaggagaaataataaagagaaaaatgatgggaaaaatattggagaagggaattggagagagtatttatctccaacgattgaattgttagagaataagggggcggcaagtggcatcatggcgaaacatccaaaaatattaaaaataatatctgccgccatgctctgcttttgtgcgttagcgttaggaaaggaacgacaaaaaggaaagactacaatgacaggaatcggctatgcgttacttcttggaggaggtatcagtaattttatagacaggatgaaaaagggttcggtaacggactatgtacgttttcctaaatttccagtaaaaaagattagtgagctggtatttaatctcagtgattttggcatatttgcaggagtattttgtctgttgcttcgaaaaaaataggggaaaagggagggttattctgaagcttcaggcaggtatgattctgtctattattcaaaagatagagaaaaaatagaaagttattgcaaaagtttagaacggcatgattttatatattatttctccaaaaacagagaaaaggaactgcaaaaagaaaagtaaaagaagcataaaaagtgagaataagcacgaagttatcggataataaaaaatattttcagaaaatagagagaaacagagggaagagcagaatatggccgggaattgtgcagaatagacaatgaaatatacataaatttacaaacaatagaagggtaaaaaatgcaggtggataagaaaatacagttatccacgggagaaaaagctgaaaaatgtcgataaacagacttatccactaagttatccacattatccacagtggaaaaacaaagggaaagaatggaaaaacatcgtcaatataaaacatctgttttgtgcgattttttaaaataatacattgccagaatgcagaattgttggtataataattgtaatataagaaaaaggagtgtgatcgtatgcgttacattatttacggcaaaaatctggaggtaacagaaggattaaagcaggctgtacacgataagttcagtaagctggagaagttcttcacaccagagacagaagttcaggtcacattaagcgtgcagaaagataaccagatcgtagaagctacgattcctatgaagggaactattttaagagtagaacctaacagcacagatatgtatgtttctattgatatggcagttgatttactcgaacgcatgattcgtaagtataaaacaaagatttccaagtacggaaagggagagttaaagtttaatgatgagttcatggaagaagatgtggacaatcatgagacagtaactatcacaaagagtaagagatttgcaatcaagccgatggatgttgaagaagcctgcgtacagatggaactgttaggacataatttcttcgtattccgtaatgcagagactttcgaagtgaatgttgtttataagaggaaagacaaaacatatggtctgattgaaccagaattttagaaaattaagcggaaattcctggtgcttaattgccgggtatgtcgcaagacagttccattattaagattcgacaggataagggaatgtattttttagattctggatatgagatactattgaagaaatacatggaattattaacgaaggaagaaggcagatattttctatctgcctttcctttttctgcatattattctgtatattaatgtatattaaggggattaaagcttgaaaagagcttctatcaatgttacaatataagctgtatgtttaaaatgagcgtacagtatctattaagataatcataccatataggaggtaaatatgggtttagttgataaactttttggaaataaaagtgaaaaagagatcaagagaatcgaaaagtatgtagatgccatcgaagctcttgacgagaagatgcaggcattaagcgatgaagagcttcgtgcaaagacacaggaatttaaagaccgtctggcagcaggcgaaacactcgatgaccttttagtagaagcgtttgctgtagtaagagaggcagcagaccgtaccatccacctgaaacactatcgtgtacagcttatgggtggtattattctgcaccagggacgtatcgctgagatgaagactggtgaaggtaagacattagtttctacacttccagcatacttgaatgctcttgaaggaaagggcgttcacatcgttacagttaacgattacttagcaaagcgtgatgcaaactggatgggacaggttcaccagttcttaggtttaagtgttggtgttatcttaaatagctatgataatgcagaacgccaggcagcttataactgtgatattacttatattactaataatgaattaggtttcgattatcttcgtgacaacatggttatttacaagaaggatcttgtacagagagaactgaattatgccattgtcgatgaggtcgattccgtattgattgatgaggcaagaaccccgcttatcatttccggtcagagtggtaagtccacagacctttacaaagcatgtgacgtacttgcaagacagatgcagcgtggtacttctgatggtgaactttctaagattgatgccatcatgggtattgatatcgaagaagatggagacttcctcgttaacgagaaagataagcaggttatgcttacgacagaaggtgtgaagaaagtagaacagttcttccacattaagaaccttgcagatgcagagaacttagagattcagcataacattatccttgctcttcgtgcacataatcttatgttccgtgacagagattacgtagtaaaagataacgaagtgcttatcgttgatgagtttaccggacgtatcatgccaggccgtcgttattctgatggtttacatcaggcaatcgaggcaaaggaacatgtaaaggttaacagagagtctaagacacttgctacgatcacattccagaacttctttaataagtataagaagaaagccggtatgactggtacagccatgacagaggacaaggagttcatggatatttatggaatggacgtagttgagattcctacaaataagccaatgattcgtgtggatcatgaagatgccatctacatgacaaagaaagaaaagttaaatgctgttatcaatgatattgtagaatcccacaagaaggggcagccagtcttggttggtaccattaatatcgatacatctgaagaagtaagcgaactcttaagcaagaggggaatcaagcataatgtactgaatgcgaagttccatgaattagaggcggagattgtttcccatgccggtgaaagaggagctgttacaatcgcaacaaacatggctggccgtggtaccgacatcaagcttgaagatggtgttgcagaacttggcggtttaaagattatcggtacagaaagacatgagagtagacgaattgataaccagttacgtggtcgtgccggtcgtcagggtgacccaggtgaatctaagttctacttatctcttgaagatgatttaatgcgtctgttcggttctgagagaatgatgggtgtctataaggcattaaagattccggaaggtgaagagattcagcataagacaatcacaaaacagattgaaaaggcacagaagaagattgagaacaacaacttcggtatccgtcgtaatcttctcgattatgaccaggtgaacaatgatcagagagaggttatttacgcagaaagacgccgtgtattgaatggtgagagcatgcgtgatgttgtttacaagatgattaaagacgttgttgctgacgatgtgaacatggtcgcaggcgagcagccattaaaagagttaaatcttgtagaactgaacgagtctttaagaagaaagattccattagagccaatcactcttacagatgaagaaaaagagaagaacgacaaagaagctctgatctctcgtctgcaggatgaagcaatgaaggtttaccataagaaagaaaaagacttcaacgaatttgccaaagttaatgtgccagaggaaggtgtagaacttggtgaagaagatgcagcaatctttaacgatggtatccgtgaggtagagagggttatccttcttaaagttattgacagtaagtggatgaaccacattgatgatatggatcagctccgtgagagtatcggacttcagtcctacgcacagaaagacccagttgttcagtataaattccttggatacgatatgtttgaggagatgacaaagaacattcgtcacgatactgttggtgcattaatgcacgttcagattgagcagaaggttgagagaaaacaggttgcaagagcaacaggtacaaacaaggatgagcttgtggaaagaggaccttaccgcagaaaagaagcaaaaatcggacgtaatgcaccatgtccatgcggcagcggaaagaaatataaaaactgctgcggaagatttgcaaattagtgtgtgcttggaaagacatttttaaaacgcgctccgcgcaggaaaagttttgcacagtgaatattttgcagcagatgcagagaatgcacctgcgaaggaataggcactgtgcctttctttatcatatacatggaactattcaaatatacagataactacaggtaatcgttctaaaagatttcaggatgaataaacgtccttgagaagttatactgaatgattgcaggtttttatattttgtctacattttatataatagagagggttttataattggttgaattagaacaatacaaatttacggtaaatcaatataaagagccgatgaaagagcttggcgtttctctggcactttctcataagcatgagcagattaaagaattagaaagtgaaatgcgggaagaggggttctggaatgacccggacaaggcacaggaagttaccagaaaagttaaaaatctcaaagataccgtttctgcctatcatgcattagaattaacgctggatgatgtttctaccatgattgaacttggtaatgaagaaaatgatgccagtgtgattccagatattgaagaattacttggagaatttgagatagaatttgataatttaaagattcagacacttttatctggtgagtatgataaaaataatgcgattgttacccttcatgcaggtgcaggaggaacggaatcctgtgactgggcaggaatgctttaccgaatgtatagcaaatgggcggatagtcacggctttaagacagaagttcttgattatctcgatggagatgaggcaggaatcaaatccattacatttgaagtaaatggggagaatgcttacggatacttaaagtctgagagaggagtacaccgtcttgtgagaatttccccatttaatgcagcaggaaagagacagacttcttttgcatcctgtgatgttatgccggatattgaagaagatttatcagtagagattgctgatgaagatatccgtattgatacctaccgtgccagtggagcaggtggacagcacattaacaagacggattcggctatccgtattacccatattcctactggtgttgtcgtacagtgccagaatgagcgttcccagcacaagaacaaggataaggcaatgcagatgttaaaggcaaagctgtatctgattaaggagcaggaaaaccgggaaaaattatcagatatccgtggtgaagtgtccgataatggctggggtaaccagattcgttcctacgttatgcagccatatactatggtaaaagaccacagaaccggagaagagaccggtaatgtgcagagcgtgatggacggcaacctggatgcatttatgaatgcataccttcgctggatcacaaccccaaagaaggcttaaaatgaaaattacagacataaggagcagacagaataatggatattataaaaaaactggcgcaggaacttgcgattaaagaagaacaggcgaaagcagcagtacagcttattgatgagggcaatacgattccgtttattgccagataccgtaaagaaatgacaggagctcttaatgacgagacactccgtaatttacatgaacgccttctctatcttcgcaacttagaggagaaaaaagagcaggtaatcaatgcgattacagatcagggtaagatgacagaagatttaaagaaaaagattctctcagcagaaactctggtagcagtagatgacttataccgcccatatcgcccgaaaaagcagacaagagcgacaaaagcgaaggaaaagggcttagagccattggctaatattcttcttttacagaagacaacaaaaagcatggaagaagaagcagcagcctttgtgaacgcagaaaaaggtgtggcaaacgcaaaagaagcgattgccggagccaaggatatcattgcggaaatgattgcagatatggcagattatcgtaaaagcatccgtaactgtacgatgaaacagggaagtcttgttgtaaaagcaaaagatgagaaagcagaatctgtatacgaaatgtattacgatttcagagagccactttctaaagttacgggatatcgggttcttgcgattaaccgtggagaaaaagaaaagttccttactgttaaggtagaggcaccagatgtgcagattgtcaatgcattaaataaaacaatggtgaaggataatctaaatacaaaagcactcatggaagaagcgatacttgatgcatacaatcgactcattgccccatccatcgaaagagatattcgaagtgaaattacagaaaaagcacaggaaggtgccattactgtctttggaaagaatttaacacagcttctcatgcagccgccaatggaaggaagaacagttttaggatgggaccctgcattccgtactggatgtaaacttgctgtggtagatcctacgggtaaggtgttagataccgttgttgtatacccaactgcaccacagtgtaaggtagaacaggccaagaaaacggtacatgatatgattaagaaatacaatgtttctgtaatcagtgtgggaaatggtactgcctgccgtgaatcagaacaggttatcacagaactgatcagggaaataccagaacaggttgcttacgttattgtaaatgaagcaggcgcatctgtttattctgcaagtaagctcgcaaccgaagagtttccggaatttgatgtaggacaaagaagtgcggcctctatcgcccgaagattgcaggacccgttggcagagcttgtaaagattgagccaaaagcaattggtgttggacagtatcagcatgatatgaaccagaagcgattagaagaagcgttaaatggtgttgttgaggactgtgtaaataaagtcggtgttgacttaaatactgcttccgtcccattgctttcttacattgccggaatcagcaaggcagttgcgaaaaatattgttgcttaccgtgaggaaaatgggcgtttccacaccagaaaagaactcttaaaagtgccaaagcttggaccaaaagcatttttacagtgtgcaggtttcttaagaatccctggtggagaagaaccacttgataatacaagcgtacatccagagtcctacgaggcagcgacaaagttattaaatgatttgggctacacatcagaaagcatccgtggcggtggtcttagctctcttaattctcagattaaagatgaaaaaggattggcagaaaatcttggcattggtgagatgacacttcacgatattatagaagaattagaaaagccaggaagagatccacgtagtgaaatgccaaagccggtacttagaacagatgtccttgagatgaaagacttaaaagaaggcatggtcttaaaaggaacggtccgcaatgttattgatttcggtgcctttgtagatattggcgtgcatcaggatggtttagtacacatttcccagatgacagatcgttacattaagcatccgcttgaagtagtcagtgtgggagatattatagatgtgcaggtaatgagcgtggatttaaacaaaaagagaatccagcttacgatgaagattgaccacaacaagtaaggctgtggtcacaataggaggggcaaaacgtgaagagttttgaagaaataagcaagatgaatcttgcagaactcgacagaccagttggggtcggagaggaagaattagaaacagaaactaccggagcggctggaaatcacagtgtcagtgatgcggaaaaggcaggaacacccggtgcagatgacttagaaacttctataaatatgtcagcggcagtttccgataatgaagaagaaaagcagccagaggaattagaaaaaaaagtgatgatggagccacaggggaagcattatcgcattgatgcagacattacacagtcggcactgaataccttcctttttgggcatacgtatcgtcagcctttgatgattcttgtcactgttttagcaattgcatggccgattgccgttatcgttaaaaaacagggtaatattgctatgccattaatctgttccttatttattctgatatggattccatttacgacatatcttcgtgccaagaatgcaaggaagttaaatccaatctatgagcagacattccattacatgcttgacgagtggggcttacatctggaattatcagaaaatgcgattgatgtggagtggaagaaagtaacaaagataattttctataaatccgttgcggttatttataccggaaagaataatgctttcctgattcctacagaggcaatgggagcacagcgggcagatattttaaacttcattgaagaaatgaaaaacagataagagacaaataaaatagataagcaaaaaagtcaaagacaaataaagaatcatgtcctttcgaaggctttctgtgattggttttatgagatgatgaaagaacaattgcaaatatgagagaaagaaaactctgtgaggacaagatagataaaaagaggtaaacatgaaaatagaaagtaacagcgcagaagagacatttgcactgggaaaacaatgcggagaaaaggcagcagcaggtcaggtttactgcctttacggtgatttgggagtcggaaaaaccgtatttacaaaaggatttgcggcaggacttggaatcaaagaaccagtcagtagtccgacctttactattttacaggtatacgatgagggaagacttccattttatcactttgatgtgtaccgcatcagtgacccggaagaaatgtacgaaattggttttgaagaatatatcgagggagaaggcgtctgctttatcgagtgggcgaacctgatagaggaacttctcccggcacagtatacagaaattcatatcgacaaagacttatccaagggatttgactatcgtctgattaccgttgaggaggtgcaaagatagatgaaacttcttgcattagacagctctggattagtggcctctgttgccattttagacggggagactcttgttgcagagtatacattaaattataaaaaaacacattcacagacacttttaccgatgcttgatgagattgtgaaaatgacacagacagaactttctgagatggatgccattgcggtagcggcagggccaggttcttttacagggcttcgtattggttctgcaacagcaaagggacttggactggcactgaataagccaatcatttccgttccaactttagaaggaatcgcctgcaacttttatggtacagatgccattatctgtccgatgatggatgcgagaagacagcaggtatataccggaatctatcattttgcaggtggaacagagtttgaagaacttgtcgcacaggaggcaggcccggttgaagatattattaaaaagtgcaacgagcttggacaaaaacttggtaagccagttatttttttaggagatggcgttccagtatataaagatattattgaggaactttgtaacgtagagcattcttacgcaccggcacatttaagtcgccagagagccggagcggttgccattcgtgccatgaagttatacgaagaaggcaaagcagagccagcgagcgaccatgcgccgatttatttaagaaagtcacaggcagaacgggagcttgaagcaaagggaaagaagttagaagaatgaaaatttgcccaatgaccgaagcagactgtgaaaagacaggacttctgatgaaagaatgtttttctgttccgtggtctgtagaaggtttaaaagagatgtttcataccgaaggctattgttctttccttgcaaaagaagaagaagaggtaatcggctatgttggtatgaaaatggtgcttgatgaagcagacattacaaatgtggcggtactgccttctcaccgaaaaaagggaattgccggaaagctgttaaaacagttattagaagaggcaaaaaagcagaatctgcacagcatttatctcgaagtccgtgcttccaatatagcggcggttaccttgtatgaacacgctggatttaaagaagtcggacagagaaagaattattacgataatccgcgggaagatgcaagacttatgctctgggaggcataaggatgacagtagttaccagtactttttgtcgtatttttttgtataatggtatcggaagaattacaaaaatagttttattttaagaacgattctttctatagttaaatggcctatgagatttatggtgagatacgatattaaaattagaagaaaagtttttgaaaatggaggatacaatggataaaaaagtacatgaaatttactgtaattcctgtggaaaaaagatagagacaacagacaatattaagagagaagattacctttccatcaaaaaggaatggggatacttctcaaaaaaagacggggaaatacacagtatttttctgtgtgaatcctgttatgatatatggacgaagcagtttaaacttcctgtaaaagtggagaaacagacagaactgctatagaaaagtgagggatgttatgctggaattgtgtttgcttggctgtggaggaatgatgccgctgccataccgcaaactgacatcattgatggcaagatacaatggaaacagtattttaatagattgtggcgagggaacacaggtggcgatcaaggaaaaaggctggagttttaagccgattgaagtcatctgctttacccattatcacgccgatcatatcagtggcctgccagggcttcttttaacactgggaaatgcacagagaaccgagccgctgttaatggtaggaccaagaggattagagcgtgtagtaaactcattaagagtcatcgcaccagacttaccgtttccgattgtttttcatgaattaaaggaaaaagaggaagtgcttgatgtatgcggctgccgtattactgcatttcgtgtgaatcacaatatcacctgctacggctatacgattgagattgaccgtgccggaaagtttgatgtgaacaaggcaaaagaaaataacgtagagatgcagtactggaatcgcctgcaaaagggagagacaatcgagctgcctgacagaacacttacaagcgatctggttctcggaccgtcaagaaagggtatcaaatgcacctatacaaccgataccagaccaacggattccattgtggaacatgcaaaagatgccgatttatttatctgcgaaggaatgtatggcgagccggaaaagaaggcgaaagcagtcgaatataaacatatgacattttatgaggcagcagaaatggcaaagaaagcttgtgtgaaggaaatgtggcttacgcattacagcccgtctttagtaagaccggagccatatatggaagaagtaagaaagatatttgccgctgccagtgccggaaaagacggaaaaagtacgactctgttatttgaggaggaataggaaacatggaagaacagaaaaaagatgtattgattctggcaattgaaacttcctgtgatgagacagcagcagccgttgtaaaaaacggcagggaagttttatcaaatacgatttacacacagattaaactgcatacgatgtttggtggtgttgtgccggaaattgcatcaagaaaacatatagaaaaaataaatattgtaattgagacggcattaaaagaagcagatgtcacattagaagacattgatgctatcgcggtcacttatggtccgggattagttggtgccttacttgtcggcgttgcagaagccaaagcacttgcttatgcagcgaagaagccgttagttggtgtgcatcatatcgagggacatatcagtgcgaactacattgaacataaagaattagagccgccatttttatgtatggttgcttccggcgggcattctcaccttgtacttgtaaaaggctacggggaatatgagattatcggaagaacaagagacgatgcggcaggagaggcatttgataaggtcgcaagagcaatcgggcttggttatccaggtggtccaaagattgataagcttgccaaagaaggcaataaaaaagcaattgcattcccaagagcaaagattactgatgcaccggatgatttcagtttcagtggcttaaagtccgccgtattaaattacttaaatcagtgccaaatgaaaggtgaggaagtcaatcgtgccgatgtggcagcttctttccagcagtccgttaccgatgtgcttactgaacatacagtaggagcggcaaagcgtcttggcattaataaggtagcaatcgcaggcggcgttgcttcaaactcttctcttcgcgcgcagatggaagaagcctgccgtaaaaatggaatagaattctatcatccatcaccaattttttgtacagataatgcggcgatgatcggtgtggcaggatattatgagtatatcaaaggtattcgtgatggctgggacttaaatgcaaagccgaatttaaaaattggagaacggtaaagatttgaaaaacaggagggagtacatgaaagaaaaagtaacagcgattgttcttgcggcaggaaaaggaagccgaatgcattcagaaatacaaaagcaatatatgactctcttagaccggccggttatcacctatgctttagaagcatttgagaaaagttctgtagatgagattattcttgtagttgctccgggagaaatagaatatgcacaggaaaacattttagataagtatgattataaaaaagtcagcggcatcattaccgggggtgcagaacgctatgactctgtatataaggcattgtgttccatgccagaagagggatatgttttaattcatgatggcgctagagcttttatcacgccggaattgattgaattttgcattgatcaggtgaaaaaagacaagtcctgtgttatgggaatgccggtaaaagatacgataaaaattgttgatgaggatcgctatgcagtttctaccccaccgagaagcaccatgtggcagattcagacaccacagtgttttgtgacagcagaaatcagagaagcttaccagaaaatgatggaagcgggggatgattctgtaaccgatgacggaatggtgatggaaacttacggaatccgtggcgtccgcatgataaagggaagttacgaaaacatgaaaattacaactccggaagatatgctgcttggcgaggcaatcttaaaaggcaggagtacggagaggtaatgacaggagatacaaacatgaaaaaggaaaatacgataaatcaggaacaggaagaaatggtatttgcagaagctcctgcacaggttatttttaatgaaaaaaaggagccggacgatattgtagaagacgatgcagaagaaattgacgaagaggattatgagattgaagatgacggagacgaggaagacgatactccgaaaaacaagtttgagtcctgctgtgtctgccatcgtacagaagaacaaggtgcaaagctcatccatatgccgacaggtttaagcatctgttctgactgtatgcagaagtcttttgattcctttaattctggatttggtggtggaaatggcatccagttccttgacctgtccaacatggactttaacaatttaaaagatatgaatcttggagatctgttatcaggaacgatgtctaaccagaagccaaagacaaaaaaggcaaaaaagaaaaagaagaaaaataagaaggaagaaccaaagcttactttaaagaatattcctgcgccacatcagattaaggcacagcttgacgagtatgttatcggacaggattatgcgaaaaaggtaatgtccgttgccgtatataaccattataaacgtgtcattacaaatacgatggatgaaatcgagattgataagtctaatatgcttatgatcggaccgacaggttctggtaagacccatcttgtaaaaacattagcaagactgttaaatgtacctctggcaatctgtgatgcaacttctcttacagaggcaggttatatcggtgatgacgtagaaagtgtgctttctaaattacttgccaatgccgataatgatgtagaaaaagcagagactggaattattttcatcgatgagattgataaaatcgcaaagaagaaaaatacgacaagccgtgatgtaagcggagaatctgtacagcaggcactcttaaaactgttagaaggcagcgaggtagaagtgccggtaggtgcaagctctaaaaatgcgatggttccgactgctgtaatgaatacaagaaatattctctttatctgcggtggtgcattccctggattagaggatattatcaaagagagaatgacacagcattcctctatcggattccatgcagaacttaaggacaaatacgatcatgaaaagaacatgttgcagtatgttacagtagaagatatccgtaaatttggaatgattccagaatttattggaagattaccaataatatttacattaaatgccttgacaaaggaaatgctggttgatattctgaaagaacctaagaatgcaatattaaaacagtatcagaaacttctggcattagatgaagtggatttgcagtttgaagatggagctttgacagccattgcggagaaggctatggaaaaagatactggagcgagagcacttcgcgcgatcatcgagaaattcatgcttgatattatgtatgaaattccaaaggatgataatatcggacgagttacaatcacagaagactatatccgtaacaatggagctccgcttattgagatgcgtccttatcttcagcttgagcagaagaagagagagatagcggctgcggaagagcagaaagagaattaagtagaaactagagtgtgtttgaaaattattcctgcaagctgtatgtccaacttacggtagatgcggtaaagaagtacagatacaaaagacaaagtataaggcaaaaatatttaataacgatataatgttaaaattccatagagggggttaattatggaaaagttaaacctgaagtttttgcagagtctggcaacacagtatccaagcgtggcaaaggcctgtacagagattatcaatctgcaggcaattctaaatctgccaaaggagacagaacattttgtttctgatgtacatggggagtacgagcaatttctacatatcttaaaaactggctcaggagccattcgcaataagatagaagatgtttttggtaatacactctgcgccagagataaaaagagtctggcagctctgatttattatccagagcagaaagtagagcggatgcggttagagttatctgaagaagattttcaggattggtataaggtatccctgcatcgcctgattgcggtatgtaaggaaagctctgccaagtatacaagatcaaaacttagaaagagtctgccggctgatttttcttatatccttgaagagcttttgagtgaaaataaccgtgttgtagaaaaagaagaatattataatgaaatctttgatacgattatccgcttaaacagagcgaaagaatttattgttgccattgccggggttattcagaagttagttgtcacacggcttcatgttatcggagatatttttgaccgaggcccaggcccgcatatcattatggatcacctgatggaacacagtaatgtggacttccagtggggaaaccatgatgtggtatggatgggagcggcttctggtcaaaaagcctgtattgccaatgtcattcgtctttcagcaagatataataatcttaatgtattagaagatggatatggaattaatcttgtcccactcgcaagttttgcgattgaaacatatgcgaatgatccttgtcagtgcttccgggttcatgcacaggaagactctgatttaagagaagtatctctcaatatgaagatgcataaagccattgctattattcagtttaagttagagggacaggtgatcaagagaaggccagagtttaatatggacaaaagactccttcttgataagatcgattacgaggaaggaaccattatgatagaaggtaagaagtatgaacttcttgataaatccttccctactattgacccgaataatccatatgaactttccgaagcagaagaagccttgatgaaccgcctttgcatgaactttttaaactgcgataagttacaggaacatatccgtttcctatttaataaaggcggtctgtatctttgttataattccaatcttctctatcatggctgtgtgccgcttgatgagaagggaaacttccgtaaagttaagattggcagcaaacagtattctggcaaagaactttatgatgtgcttgagtactacgcaagaaagggatattacgagcaggataacagagaagaacatgaatatggaaaggatatcatgtggtatatctggtctaatgagaactccccagtctatggcaaggaaaagatggcgacatttgagcggtatttcattgccgataaagaagtgcagattgagagaaaagaccattattaccgcctgatagagagagaagatgttgtaaataatatcctcaaagaatttggcgtagatatcgaaaaaggtcatattatcaatgggcatatgcctgttcacgtaaaagagggtgaatcccctgtcaaatgtaacggtaaagtcatgattattgatggtggcttttcgaaagcgtaccgcggaacgacaggaattgccggttacacccttatctataattcaagaggtctgcgtcttgtttctcatgagacatttacttcgacagaagacgttatcgaaaaagagatagacgtacattctgataccgttatccgtgaggtttctgctcagcgtgagagagtgatagacaccgaaacaggccgccagttgaaagagcagatcagtgaccttgagaagctgctgcatgcttatcggacgggacagattttggaaaaagaataaaaggagacgaactccaaaaagagaatccatagaagggcatatttctcttgtaaactaacatatatttaataagacaatctgagatagtgtgttacgtttttttataaacagggagatttttatcttcttctagcaagaagattccccatttaaggggatatcacttggtatacagagaaaacgggagggttgctatgaatatggacaggagccagaagaatttggagaagaaaaaggatgatagaacgattgaatatttagaattgaagtatgatacaaatatacaaagggggcttacgctggcaaaagtgaggcagaagcagcgtgggaagaggagttctaggaatagtataacgaaagagaagaagcggatttggtttatgtgtttaaaacaggagtgccaggatctgcttttctttttctttctatatttatgtgtggtaagtgttttgtttcaatttgatcaaagagtaaaaacagtgttgtttgtgtcttttatggtatttctttttgggaaggtggaaaagacatttcgttatagtaaagtattatttaagaaggaagaaatatataaaactaaagtagtggttttacgagaaaatatatttcaatgtgtgcaggtaaatagtcttgtaaaaggggacattgtgcgtttgaaaagaggggaaaaagttccgctcgctgttataagtttaaagttaccatataaagaatataaacagggagaaatttttgcagaaaatacaggacgggctattgtaatacagcaggtggtgtatcctttctttgaaaatgtgaaagagaatacaggtataaacagaactgttaaaatgacagagaatatagaagataagtatgtagaaaaaaatgaaagcatgaaaggaaaaatctctttgaatacaatttgtaaacaaaggaagaaacaaggaagactatatgcggcagaggagaaagagagagaagaaaatggaggaagttatacagaaaatatgattctccaggaaatttttatccgtcagggaatttattttcaaccagattttttaaaaaaaactgtggtagaaggagacaggccaatcgttgctgttggttttgaagatatatattttccgtccagatttcaaaaggagaagtttcagcgatttatgcagggattaaagaaaacaggtgtgaaatacttcttttttacgaatcagaacagagaatcggcattttctattggaaaacagacgggaatagtgaaagaaaaaagagaagtgatagatagaaaacagtttttgcttctaaaaaacgtggctctcgaaaaacagataaaaagtattcgcatttattgcggactttcagaagtcgaaaaaagccagattatagccatatggagaaaacatcagcaggaatattcaaaaaaattcttgcaaaagcagggaagaatcctgtttatgtctggtttaaatcagagtggcagagaaaaaataacagaagattgtgtatacgcctgttgccatagcggcagccaggagggggatatctggttcaaaaaaaattggagagatacaatcgtaaaatatcttactggacaaaatatctggcagaaatttcttgaaaatacccaaaaatgggaaggacagattctggcaagcttatgtatatttatgctcatatctcttctgctgtccttatatatgccacaacaggaaaacatgcagaaaattacacagacaggaagcctgttttgtgcagcatatattattggaaaagaaattgtagaagaaggattccgcaaatggtttctgaaaaaattgaaaaataattagattctgatttgcgtagcaaaggagacgccgctgtagaggaatctgtagtcggattgccagaaggattattgagaagaacctctaaaaaaatttattgattttgttccgttgtgctaaacgctccattttgcccaataaaacagaaacttcgtagaaacgaatgcgaagtttctatggtcaaaattctacagcacaaagtcacaaaattcaataaattttttaggggttcttcctcgtattttttgagcaatcctacagaaaatttacagcggctaactattccaaatcctacaaatcagtttcatggaaagctataatcgtctgaatgatatccaaatcctataatatgaattctgattttgcctcggcaacctggaagtttacaaaattaataccacttatggattattgaattttatcctgcgtttatgctaatataattaacaagcgtaacgatatgaaaaggctgaaggatttcgtatcattacaaatatcttactaataatatattttaggaaaggaaaagctattcaagcgaaagcttcaatagcaggatagaatgatggaactgttaaaaacaggagcgtatcttgtaaatggaacagaaattatagaagatactccggaagcccaggcaagactgcaggcagtggctggtccgaatgcaccttctaaagaagaagcagcgaagggaacaattgcttatggtattttagaagcccataatacttctgataacatggaaaagttaaaaattcgttttgataagttaacttcccatgatatcacttatgtaggaattatccagacagcacgtgcgtcaggattagagaagttccctatgccatatgttctcacaaactgtcataacagcttatgtgctgttggtggaacaatcaacgaagatgaccatatgtttggacttacctgtgcaaaaaagtacggtggaatctatgtacctcctcatcaggcagttatccatcagttcgcaagagaaatgcttgcctgcggtggagcaatgattcttggttctgattctcatacccgttatggagcacttggaacaatggcaatgggtgaaggcggaccagagcttgtaaagcagctcttaaaccagacttacgatattaatatgccaggtgttattggaatctacatgacaggagagccaataaaaggtgtcggtccacaggacgtagctcttgcgattatcggagcagtattccagaatggttatgtaaataataaagttatggagtttgttggaccaggtgttgagaagctgagtgcagacttccgtatcggtgttgacgtaatgacaacagagacaacctgtctttcctctatctggaaaacagatgatgtaattaaagatttctatgatatccatggaagagtagaagattacaaagaattaaatcctgcaaaagttgcttactatgacggaatggttaagattgatttaagcaagatttgtccaatgattgctatgccattccatccaagtaatacatatacgattgaagatatgaataagaacctgatggatgttcttcacgactgtgagcagaaagcacttgtcagcttagatggacaggtagactttaaacttaccgataaagttcgcgatggaaagctctatgtagaacagggaatcatcgcaggatgtgccggtggtggatttgaaaacttatgcgcagcagcagatattatcaaaggaaaatctattggagcggatgaatttacattaagtgtttatcctgcaagtacaccaatctacatggaattagtaaagaatggtgcagcagcagcccttatggaaagtggtgctatcgtaaaaacagcattctgtggtccatgtttcggtgcgggagatacgccatccaacaatagcttaagtatccgtcattccacaagaaacttcccgaacagagaaggttctaagttacaaaatggtcagattgcttccgtagcattaatggatgcccgctctatcgcagcaaccgcagccaataaaggataccttacgccagcaacagatcttgatgtagaatatacaggaagaaaatatcactttgacagcagcatttacgcaaatcgtgtatttgacagcaaaggagtggcagatccatctgtagagattaagttcggaccaaatatcaaagactggccaaagatgagcgcgcttccagaaaacatgattctaaaagttgtgtcagagatccatgatccagttacaacgacagatgaattaattccatcaggagaaacatcctcctatcgttcgaatccacttggccttgcagagtttactctttcaagaaaagatcctgcttatgtaggacgtgccaaagaagtaagagcagcacaggaagcagtagaagcgaacagcaatccagtagaagcattagcagaattagcaccagtaattgatgcaattcacgctaagtatgcagatgttaccaatgaaaatattggaatcggaagtacaatctttgctgtaaaaccaggtgacggttccgccagagaacaggcagcatcctgccagaaagtattaggtggctgggctaacattgcaaatgaatacgctacaaagcgctatcgttccaaccttattaactggggtatgcttccattccttattgaaaaaggtgacctgccattcgcaaacggagattacattttcctgccagacgtaagaaaggcagtcgagacaaaggcagcagaatttgaagcttatgttgtaaaagacggaagtctcacaccatttgctttaaaaatgggtgaattaacagatgatgagagagagattatcttgaagggatgcctcattaactacaatcgacagtaattctgagttgccgcaggcaaggtagacggtgctacagaggaagtagcgttcggattaccagaagattatgagtagaaccactaaaaaattgccccattttgttccgttgtgctaaatggggtagatttttaagtggttctttcttgtgttttttgagcaatccgactaaaagcttttgtagcgtctcccttgcctgtggtaaatcaaaattgtatacatattagtgcactattgacaaaaggaaagtatttggtatatcataaaaaagattattaacttttaaatgtaagttatctaaaaatcagaacaaaagacaattgacaacattgaatgagagaagaaggagtggagtaagcatgaaggtttcaggaaatgacctgtttgtaacggcaatgaaaaaggaaggcgtggatacgattttcgcatatccgggtggcatggtcgtcaatcttctagacgcactccatgattgtcacgggattgacctcgtattaccaagacatgagcaggggttgattcacgcagcggatggttatgccagagcaaccggcaaggttggtgtatgtttagtaaccagtggaccgggtgctacgaacttagtaacaggaattgctacagcaaactatgacagtattccattagtatgttttactggccaggttccagagcatttgatcggtaatgatgcgtttcaggaagtagatatcattggagtgactagaaatattgcgaagtttgttatcatggtccgtgatagagagatgttagcacagcgaattaaggaagcattttacattgcaagatcaggaaagccaggaccggttcttgtagatttaccaacagacgttatggcagaactgggttcaacttcttatccaacagaagtaaatatccgtggatataagccgaataagggtgttcatgtaggacagcttaagaaggcgattaatctgttagaagaagcgaaaaagccgatgtttttaatcggtgggggagtaaatctcgctcatgctcaggaagagatgacaaagcttgcagaaaagattgatgctccagtaattacgaccgttatgggacgaggagctatttccacagagcatcctttatatattggtaatatcggaatgcatggttcttatgctgctaataagactgcagatgagtgcgatttaatgttctctatcggatgccgttttaatgaccgggtaactggtgagattaagaagtttgcaccgaatgctaagattgtccatattgatattgaatccgcagcgatttcaagaaatgttacagtagatattccgattgttgcagatgcgaaggcagcaatcttaaagatattagagcatacagaaccaatgaagcatgaggaatggattgcagaggtaaaaggctgggataaagaatatcctcttcatatggaagtagaagagggagtaaacccacagcgtatcatcgagactttgaatgaagtgtatgcagacagagatacagtatttaccagtgatgtaggacagcatcagatgtgggcttcccagtatctgaagttagatgcgactcatagattagtacaaagcggaggacttggtacgatgggatttggccttccatctgccgtaggagcacagattggatgtccagagaagtctgtcgtatcaatcagtggtgacggtggattccagatgaacatgcaggagcttgcaacagcagtatgccaggaacttccgttagtaaacattgtatttaacaataatcgtctcggaatggttcgccagatgcaggaactcttctttaagaagcgttatacaattacctgcctgcgctatcataagtcctgcaagggtaaatgtggtacaccgggctgggtatgtccagagtatgttcctgatttcgtaaagatggcagaagcttacggttctaaaggatattttgttacaagtaatgatcagttaaaagatacgattcttgaggcgagagagtacgcagagaagaataagaaaccagttattgtagaatgtatggttgctccagatgaactggttatgccgatgatcaagggtggagcaagctttgaagatattatgttataggaggatgcagagatgagagagataaatacagaaaagaaaaaaagatgggtatctctgtatgtggagaaccgaattggtgtattagcacgtatttcaggaatgatgtctggaaagtcctataacatttcaagtattacagtaggtgttacagaagatcctacagtatcaagaatgacaattggcctttcttctgacgatgcaacttttgagcagattaaaaagcagttaaaccgctgcgtagaggtaattaagcttaacgatattaccgatgccccaacccatatgaaggagattcttttcgtgaagattcatgaatgttctgaatttgagaagggtgagattttccgtatctcacaggtatttggagctaaagcgattgactacggtattaacagtgttcttttagagagtgtaaatacagagggacgtaataacgaccttattgctcttttaacaagaaagtttgatcatgtggaagttgttcgaggtggtattgttgcaatagagtctatcagcatgattgaccgttaatatttagaataaaatattgtttttccattatagaatttacgatttagagcgtatttgaagaattatttcaacaatcggtatatttgttttgtagagaatatgtcctttgtttggataagatttccataaattgtgatttatacttaacagaaagtatttttgaatgcggcttaacagaagggtatttaaacatctatgtttagatactcttctttttttgcttttgggattggaatgttatatatggggaaatgaaagtacaaaaatataattgatgaataaaaaagaaataaagtaaaatattgacaattaagaagtggaatgctaaaatgaaatggaaatatttcctaaaaatgaaaggagtgtaaaacgagaagagagatattttaagcaacagggaaatatagaatttttcaggagggcagaaaatgcggatattttttaggagaatccttatttttgttttagtagctgcacttttttttacaaatatcaacataagcgtagctgcttctggaatagggaaagagagtttctaccagatgaaaaatgaacaggaagataccagacagatagagaatattacaacagaaagtcaggagagtacgacagccatttctaaagaaacaacggaagaaaaggaaaaatcagagcaaggaaccacggagcagcataatgaagcagaagaaaagtgtacagagcaggaatcggaaagtgcaggaacacaggataaatctcagcaacaacaggagaaattaacaggttcagaactaaaagaagggggacagacaaaaaaatctacagaaaggaatcaggaacagtccacagcggagcagagggaagacgaggaggaagagtctgtaccagtagtaatgtctactcatccaagcacaaaccattctgtaacaatgcctgatgttaccagccattattttttattacaaaaaaacagcaaaaaagtgggaagcgtgacaggaaaaaatctgcttacagtagctaatgcacaggcggcatcgaagtatatttatgaaagttattcaaatggaagacagtacaattttactccccgttttaataataacagttcagtaagcgttggtggaggaacaggaggggaagtttcttttacaaaagtgaaaaatggaacagaaagtgaatttggtactttatatcctgccgtatcgaaaggacgtattgcatcgaaagtatttaatttacagaaaactacggtgaatccatacgcagtatataaagatgttggaaattggtatgattataatacgaagagaacatataagattgatttaaagattacagtaacaggatataaatttccaagggcagcgataagaaagcagttgtcgaatcaggatttaaaagcgccatatattggattccagaagaacaagattggtatatctgttatgggtacagattatgtgcagactcgcatggatttctattatagtggaacgacaacaccggtttcaggaatcaaaggattaattcagttttgtgatattgatgcacagcagggtgttgattttggaacaggttttgagaaagtacttatgtttcagatgcagcagtcaaaacttcagtataatgcgacaggattgattactggttcgaaaggatatgtttcttcaaggacgagtgaaggttttgacaataatgatgagacaacaaccgcagttggaattttcgcgggaagtacggtgaattgtcgatggacagtagccaaatgtgaccagaaggatacgggcggtaatgcggcatatgcggtaaaaagtggatatgggattccagcggatagttcactggcagattctacatcctattattggtcaaacagtacaggactgctttctattcgtgcagatgtagggattggattattaccagatgaagtaaagaaagcgatttatcacggaaaaatcaattctaaaaattcagaatcagcaaaaaaatttctggggttgtctgatagaaaggagacattttcctatgttttatctgcaccagttccgagtccgtccaatgtaactacggcgaagtatacatcatttcagtttgaggataaagtagaatcgcttttgaacgtaaaagatgtgaaagtatatgcagatgaggcggtaaataataatgtccaggctgatcagatgaattatacagatgtaagtgccaattttaatataacaaaaacgcaagggacagatcatgccacgacagtgaaagtggcagcgaaaaatgcgaagttatcagcggcagctttttatggacacagttattatgtgcatatagaagtgcagatgaaatcggatgaagagttacataaaattaataaatcagttgcggactggtatcagacagataatactgtgactgcgaaagtatctgaggcaggaaaatgtcagggaagtgtagcagttttaaataagggaacattaaatgtagcaaataatcagggtggttcagtaaaaaaagaatcgaattatgtggcatctaaagcagggatgataattaaagtaaaaaagacagatcaaaatagcgggcagccaatcgaaggagtgaaatttggtttatttggcggtgaaaatgtcagtatagataaagcagaaccaatagatacggcagtaacaaataaagaaggaattgctgtatttaagacaggaactagctatagtttttataaagataaatatggagatggtccatattgcgttaaagaaattgctattcctgcagtctataaaaatgtgtggaagccatctcttaataaagagtggacttacaaaattccaactttaaaatcagaagctctgtttgatctttcttcaaatataccactggaggcacagttagaaaatacaaattatcaggcggaaaagaatttaataaaggtttacaaaaagagcaaagatacgggagcatatttatctggagcggaatttaccctgttacagtggtcacaatctaaaaatcaatatgaagaactctttactttagaagaagatgtggatgagaataagagatcggtttatcaaaataagcaggaatttaaaaatactctggataatttaggtcgttataaaattgtggagaagaaagcgccgaagggatgcatattaacgaagcaagagtggacgtttgaactgtcggaaaatacagacaataaggagaatcctgtcatttttgaaaatttgtcaacaggagaaaagcaaaaaggcagtttagtatatgagaatccacttcaaaaaggaaagctccttatccaaaaagaagatgatgaggggcagccagtgagtggtgctgttttttcagtaactgcggcgcaggacatttacgcaccgtgggatgtcaaggaagatggaacaccagcttctgatgcaaaacctcttgttacaaagggagaggtagtagataagattacaaccggagaagatggaaaaggagaaagcaataagtcattatatattggtaaatatatcgtagaggaaattaaaggagcatggaatcatattaaaggagatacgatttatgaagcagagctgcattatggtttagacagcagtaaagaattgattagttatcatcttaaagtaaacaatcttttgatgcatccatcacttgcagtttctaagcttgcagataaaacaaccaatgaagagaaaaaagaagtttcttttgatgaaaaaacaggacgttatatagagaaaaaggtgacaggacgctataaggcaggagaattcgttgattatacaataagagtaacaaatacaggaaatgtttctctttacaatattaaagtgacagatgatatggattgtaagggggaatttgctggacagacactctcaaaatatgcagatatggaaactgcagcatttgtacttcctgaatcgggctattttgtgacgaaaagcggagataaagtatatgctcagatgtcagcatcatctaatcttgtattaaacctgcatcatcttgcaatagctgacagcgttgagatgcatgtgaaagtaaaattaaaagaagctgtgaaagatgtgtggaagcttaagaatgaagttcgcgttcaggcacagtatgatgataatggacaagaagacgatgcggataagccacatctagttgatgtaccagtaaaggacttagtagatggagagaataatagtctggtcgtagactgggattatatcaatattccaggaattccagaggaaaaggtaataaagactgccgatagaacaacaggaattcagattgaaaatggagagataacatcagggtctaaaatacctggaatatacaatgcaaaggaaaaagtaaagttctctattgtagtaaagaattccggggaggcagctttaaaaaggattacagtaaaagatgcattaagcgatgaacttaaagccgtatccgatatggaaagtgcaggttttgtttttgatgatgcaactgtggataaagatagtttttatgttctcactacagcaaaaggaaagaagattacagccaaagtaatagataaaaatacagtgatattatgtaatacaggagaggatggttctggaacagaccgcctctttgcagatgattatattacgttaaattatagtgttaatttattgcctggaacagcgaatttatatgatctttctaataaagtatatgttaatggatggtactttaatggaaatgaagacgaagaagttccaggagaagacgatgaagatattattgaagtgccaggaataccagaaggaagaaccgcaaaactagctgataaaacaactggggttgtcttaaaagaaggcagatatgatgcaggggctaagatttccggcgtttatgagaatggaaatgaagtaacttataaaattacagtaagcaatacaggaagtgccaatttatatgatttaagattaacggatgttcttagtaaggaattagaagaagctcttgaaaaggatagtgtttcttttatagagcaggtctacacatccaaagacaatcgcaaagtgcgcacaaacttagaagaatcacagaagttatggatggatttcctggcagcaggagatgccgtagatgtgtatttgaaaggaaaagtacgcatagatgtcggaaatcttttttcacttgagaatattgtaaacttaacagcaaggtataaaaaaggagacgaaaaagcacgcaaagaacaggaagaaacagaaaaagaagaagctagtacagaaaagaaagaagaaacatcaaaagacgatgcggcagagaaagaagaggataaaaaagatgaccaaaaggatgatcaggaaggaacaaaggtaccgaaaaaagaattagaaccattatcaaaagaaagtaaaaaggcaatagaagaagcctacgaggctattcagaagcttaccgtggaagaactgaaagaagaaagtaaacaatatgcagaaatcccagtcacagaattaatgcaagacgaagattatattaatataccaggaaccccgcttgcaaagattgcaaaattagcagataaaacacagggagtcacactggtaaaaggcagatatgaaggtcagaaagaagaaggtatttatgaatacggggataccgtagattatacaatcacactaacgaatgcaggaactgcagatttatataacctgcttgtggatgacactttagataagaaactattatctgtattaaaatcagattctattactattacaactgggcaggttacaacaaagatgggagataccattcaggttaggacagcagagaaagatgaagacataggaaaagactcagaatccataacaaagcagtcagaaagtcgttctgttgtattagatcatctaaaaagtggagatagtgtcgctattcatttaaagggaatcatacaatcaggagcgaacagagacactggattaaataatatggtacatcttgtagcgcagtataaaacagtgaatgagaatggagaaaacgaagaaaattatgttgaagataccccagagatgacggataacgatacagtaggaatcggtactccagatattttagcagccaaaaaagcagataaaacgaaaaatgttattttagaaaatggacgttatacaggaaagaaaaagtatggaacttataaagagggagaagaagttcagtttatacttacagtcactaatgtgggtaatggaacggcaaatcatgtaaaagtaacagaagaaccatcagcggagttgaaaaaatatgttcaaatgaaagggtttgccaataaagctggtgatgtgatacgaacaaaaaagggaaaagaactacatatagaaacatcaaaaaaacgagaactctgtttgaaaaaaatagaagcggaggatgctgtagaactaatatacattggaaaagtaaagaaagatattccatctataaaattcctgaaaaatgaagtggtcattacaggacaaaataaagatggcagtaagataccaacgacatcaaagatgagtgattatgacaaaattaatttaaaagaaaaggaaataaagaatcaaaatccaaagaaaaatagagaaactggcacgaaaggaaatggagcaaaaacaggagataatactccggttttgatgtatagtttcttaagtgtagcagccatcttagcacttagtgttctcatctcttataaaaataaaaaacgaaaaaattgaaaacgcgaagaaacataatagcaatataacgataaaataagagagggtaagaaatattaatctctgcttaccctctcaaaaacttgacataatctatgaattttgatattatattcattgtgaaaacgaggcgtggctcagtttggtagagcgctgcgttcgggacgcagaggccgtgggttcgagtcccgtcgcctcgattctaaaaccgcataaataaaggctctgaggactccgtgaatatttagtaaatcaaagtaatcaagaagtgagattttgtacgaaggagcttaataaaattttgaaaattatatcagcaaaagcatcggaaatctacttaaacgatagattttcggtgcttttttgttgagatagttttatttgaaagagaaaataatatatagtgctttatggtctctgtcccattccaccttctaatgtgagtgtctctccgttcatatatttgaaatctggagaagcaagctgtacacaggcgcgaccgatttctttttctacatctccataatgacctgctggcggcatcttaacatttgctttgaatgcttcaggataagctttttcaaagttttcaagctgagcagtccaggcaaggggacaaacaacgttaacgttgattccgtctgcgccccattctgtagcggctacacgggaaagtccacgtattccttctttggcagcggcgtaagcacattgaccgtaatttccgaataagccagcgccggaagcaaaattaataacagatccctttgtttcttttaaatatggatagcatgctttcatgtaatagaatacggcatataatccagaatataatgcgagattgaactgttctgttgtgtggtccgcaagactgacaccagaagcagaagcctgtgcattattaattaaaacatcaatttgtccgaaagtgtcaatagcctgttttactacatttgcaacagcggcttcattgtctgttcctgcattaacatctgcctgcactggaagtacctgaatgccatagagcctttctaactcttctttcgcatcttctaatttctgcagatttcgtccggtaatcacgaggtttgcgccctcttttgcgtaagccgttgcaataccatatccaatagaaccgcaacttccgtcacttaatacggcacggccgccacctgtgataatcgctgttttcccttttaaaaatcccataatatgtactcccttctgttcgtctataattggatatccgaattacttttttatcttcttattctttttcaatttcattttctttattttacgaatcgcatgactgtatgataacagaaaattgtactaaaatcaatacacaaatctgttaatattctgacaactatgttaaataaatatcttttaactttattatctgataaataataaacaatctctttatatcctttaaaatagcgggtttccagttgaatttgtttaaagaaaaaattatctgatttttgacaaataaaaaaatgaaaatgaaacacaacatgatatagcctgcatttgtataaaaaatagcaatagttttaggcaaattaataaaaaagatgaaagaaaatgaaaaaaatattcaaaataaatttatatagctaaaatatagacaaagaaaaataaaaatgtacgcatgttggtacagaaaagttgtgcgaattgaaagaaaaattgggataaaggagcatatttatgcaagaaacaggctgataaaattgatttttagaaaaaataacaatcttaatcctattttttcttcaatgttctaactgatttcctgagctgaccataaacagaacccacaaatcattattgtcatgttatttcgccaggagtataatgtaaaaagaatatcttacaggaggcattatggcaaaatatttttattttacaagacacggacagaccgtatggaatgtagagaataaaatttgtggtgcaacagacatcgcactgacagatttagggcatcagcaggcggcggaactaggtgagagaattttaaaagaaggaattaagattgatgagattttatattctcctttaatgcgtgctgccgatacagcaaaacatatttcagaagtaacgggaattccggcgagagaagaacttcgattaaaagaacagaattttggaaaatatgaatcaactccaagaaatggtgaagaattcaaaagagcgaaacaagattttgtgtgccgttatgaaggcggtgaatctatgttacagctttgccagagaatctataatcttcttgatgatataaaaaaagaagacaaagtgtatctgttagtagcgcataatggaatctcaagagcaatcgagtcttatgtccgggatatgagcaacgaagaattcgcaggctttggaattaagaattgtgaacttcgtaagtatgaattttgattatcagagctttgtgatgatttgatttgctccaactgccaaagcacagctctttgagaatgaaaaaatccttatttgtgactttagtcgcggcgtgttgaatacttgctctgaggccacaaataaggattatttcattctcaggggcatccttcctgaggcaactcaaaatctatccagccaatctgctgtttacttttttaaagtatggtgattcaaagtcgtaatttttattgttgacgctaatccagccagttttctttccatactggaactgaaggtaaatattacctttggacagtgtgagttttttcagagtaacctgtttaccctttggaacagtaaaggcaagtttctttccgttataaaaccttaatttttttgctgttacaaaaatatttttgcggaataacttactgtaagagtcttttctgctgtaaccgattgtgctttttacggtagaagtagtagcatttgtcaaaacaagtttattattacggaatttataagacattttccaggtaagccatcctgtttcagcaggctgttctccgtgatgaagagtcagacggtttttcttggcagatacaatctcacaggcggtattgtctagtttgcttacagaatacagctttttagatgtattgttatatttgtaaatttggttaaatacaatgtaatcgttatcgccaatacccattaattgaataaactcatttttgtttgtcattttggcatatttagcggtgatataattaattccgctgtcagtacaatttttactaaaagccgttttcttatttaccgtaactttaagtttttttacgcggaaatcatcgtccatagtagttgtgataagaattttatccgcttttccatccccggtaatatctgcagatattgttttcttgacaggaatatcttttacagatgcggcattagtaatagtagagaaagatagacatagcataaccgtaagcatcaatgaaaaagtaaatttaaatgatttaaaaatagtattcttcatagcaatccctccttaaaatattgcataaaagtactacatgtataatgttactatggcatattttcagaaaaaagtccttaattatcctgaaatatttgatacaagtaccatatgtaatataatttattatatcaacaagtaagctttcaaaaaagtaactagtagtcactatttatccttttccagaaggaaatagaacagcgaactatccaacaaacatgtccagagcaattttaaaatgctatcaagcattttaagagctgtgatatgaaatgtctgtagatagttcgctgttctattttcgcttatttaacaactctagagcgtgtttgaaaaatcatttctgcaatctgcacgccccaatttgcggtatattttgccttcattcagttaaaattttccacaaattgtaacgcacatcttgcagaaagcatttttcagacacgctctagatagttgcgtttttcatttttgtctgtttattctaagattagatatttaacagatcactgtaagcctttaaagctccgtctgtatcgtgtgcaagaacacgttttgcaagaactttaccaagctgtacaccttcctgatcaaaactgttaacattccatacaaatccctggaacataatcttgttctcgaaatgagctaataaagcaccgagtgattcaggtgttaactggtcaccgataatgatactggatggacgtccaccttcgaaattcttattaagattttcatctttcttaccgcatgcgaaagcaacgatttgtgcagctacatttgcacataatttctgctgacttgtgctgtcttcgattactacatccatgccaatctggctgtttttaaatccaacaaactgtaaaggaacgatgtctgttccctgatgtaataactgatagaaagagtgctgtccgtttgttccaggttctccaaaaattgtaggacctgttacatagtttacaggttcgccgaaacggtttacagacttaccgttagattccatatcacactgctgtaagtgcgctgggaaacggcttaatgcctgagagtatggtaagactgcagtagatggatatccctgaacgttacgctcataaacaccaattaatgcatccaacatatctgggttctctaaaatatttttgtttgcagcaagtttatcttcttcagcagcaccatttaagattcttgcgaagatttctggaccaaatgcgagggaaagaacaactccgccaactgcagaagaggaggaataacgtccgccgatgtagtcatccatgaagaatgcttctaagtaatcatcactctttgctaaaggagatgtctcacttgttacagcaagcatatgatttgcaggatttaatccggcctttgttaaagcatctttaacgaaagcttcgtttgttaatgtctctaaagttgttccggatttggatacaacgatgaaaagagcgtgagctaaatcagtagattttaaaatagcagcagcatcatcaggatctacgttactgataaactttgcttccatcttagcaacaccattctcttttgcccagttctctaatgcgatatataaagcacgagggcccaagtcacttccaccgataccaatctgaactacagttgtgaacttctcgcctgcagcgttagtaatttctccagcatgaactttattcgcaaagtctgctgctttttcctgctgggaaacgtaaaattcacgcttgtttacaccgtcaacaacaacatcattacctaactgtctacgtgctaaatgatgaagaacaagacgtttttctcctgtgttgataacagcaccgttatataattcttcgaacttttcagcaagctgtgcttcttcagctaattctgttaatgcagttaaaacagtatcatctacctgttttgcagcataattaaagctaagaccttcagccattggtgctgtgtactttgctacacgttctgcaccattctcaccagccatagcttctttgatgtctacatgatttttcagtccggcaagtttttcataagatgccagagtgtcaaggttgttccaagttgccataaataaatcctccttagttaatgtgactatacattaaacatgattaaaattaagaatgtaaagaaaatgaaatctttgcatccaaaatcctatatatcaattatactaaaaaatatttccaaatgcaatggattcttactatttaattcattaagcaaactacagacgaagccattgccctcaataaggcatatttgtgcttttagtcgcgacgtgttgaatgttcgctccacgcgctcgcatccaacacttgctccgagaccacaaatatgccttattgagggcaatggcttctgtgctgtggctggagaaggtgaattaaacaggaggggggatttggggacagaagctgatgtcttctgcttactcgagaatgactgggaatagaggggatgatttgaccgcctgtatgtaatagtaaaatgaagaaatcggcattttaaatttgattttataaatattgtggatgataacataataattacatcaatttgcttaaaatctaatatagtatccaatcaataataatagtttacgaataatcttttagcagcttacaataaaagataaacgaatcaaactgggataaaaaaatatctatctacaatattctgagagcaagcagaaaacttctactctctcccccaaatccccacaaccactatttaattcaaacaaaatccagccaaagacagcccgagaagagagaagatatcctatatttgtggcctcggagcaaggtttagatgcgagcgcataaagcgagcatttaaaccgccgcgactaaagtcacaaatataggatatcttggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagagcaatcatgactaaaggaagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattgaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacatagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggtataaaaatgttgcccgatatccaaccgggcaacacaaaaattttatatttttttaattgtctacttgacgggatgcacaccatcttctctcttctcgggcgtctgtctcttaatgaattaaatagcaagaaaataatgggagaataaagctgctaagacagctccgacaaatggagcaatccccggaacaagcagtccatactgccagtcattgtcagctttatttttgatagggagtaactggaacgcaaggcgtggtcctaagtcccttgcctggttcatggcaaatcctgtagttccgccaagtcccataccaacagcccagacgataagtccgacaccgataggtaactgtttttcataattggttgcgacagctaaaatggcagttaagaaaacagttgttgcgattgtctcgacaaaaaagttacgaggaagatttctacagtttggatttgtagaaaagatatttcgaatggcaatcggatctattttcccttcgcttgctttaaaatgatcagcgtacattacatatacgacaagtgaaccaaataaggcaccgagaaattctgcaatacaataaggaataaaattggtccacggaatcatgccaagaattgcctggcataatgccatggcagggttaatgcagacacctccgaagataaacagggtaacagaaataccaaaagcccaagtggtgatagcaaaaatgtgtccgcttccatggtattttgttttagtaaggacttcatcacagtgtacgccgacaccgaataaaatcataagggctgttcctaaaaattcagctataagtgagtgtaacataacgatttttccttccgtctcttttcttttgttttataaatttatttattctaataaaagcgttttaataaaaaacaacttgaaatacattgatttttccaaatgctttcgtggctggtccttataataaaaatcaatcatgaaataatttatatcgataattatagttactgaagacttttcatattaaaattatgaaataatatcagtgattatagttactaagatttttaatactaaaatttagatattaacaacaacacctaaaccatcaggaataacagcaacttttgcatcgtttcctttgattttaaatgccatagcaagagcttcatccacgttagaagcaagttccatatgcatatcttttaccagtttcgggtcaacgagatctgataccatgatgactttatgatgtgcaaggatacgggcaaatatctgggaagtccactggtcaggaactgtttccaaacgaggagtatggatagccttttgttcaaattcttccggattttttacatcggcgatattgtggtagaaaccaactccgccatgaccatcgcggcatccggcaatcatgataatgattccactgtcaggaagagtagcttcagcggcagtcatacctttaattgcctgataaatattctggtcaagtggatatccgccgttagtagaaattgcaatatcacaatctactttatctacgcttgcaagagagcggacaaaatcgcagcctttttcatgggcagcttccatatctccggcaaaagaaccaatgatttcgtgatttccatttaatacaacattaacaatgaaagcaagatttgccgttcttgcagcgtaaaccatatcttcatgaattaaattatggcagaggttacctgggcgggattttttgtcattaataaattctccgctgtgattagccataattgttttataggaagcaatacctggcaagacggactttctgccgccggaaaaacctgcgaaaaagtgagcttcgataaagccttcggaaattaacaggtcagcttctgctgctatcttgttaataatgcagtcaccgccgcttggtaaaacaccaatttttttcatagaagcatcatccgtagaaatgtgcataacaatttcttcatttgcaacaattttctcaccatatttatcaactaattcttcatgtgtacttggacgatgaaaaccagttgcaacaagaatgcgaattcgggcatccggagatacggaacggattcttcgtaaaagaataggagtaataatttttgaaggaaccggacgagtgtggtcagaactgataatgacaatatccttttttccttttgccagttcttctaagggtttagaaccaatcggattatctaaagactgctctaccagttctttttcagaaagttcggtggtatattcgctctgttttccgtctaaaacacctgcaagatttttttcaggcaagctgattttcattgttcctttatcataaggtacgttcatttcaaacatttttaaatcctcctgtaaaattatgtgcatttgaatttgttaagtagatttttgtatataaatctcttgacgaaaatctattttatataaaatgaatctctatgaaaacaacatttcatattaataaaaagtgttagtaaaagataataataaaaaatgttatcaaatgttaccaacatctgttaaagatatgatatactattttatgaagaaagggtgaaaaagaatgaatcatgaatatttactagaatttttggaaaaaaaagatattcctaccgtacataaattacgccatgcgtatcttacttactatggattagatcagcaaaatacttatgtattaaaagaaggagtggtaaaaacaagtatcatcttaagagatggaagggaatttaatatttcttatttaaaagcaccagatattatttctttattaagagatgaagtaagtcagtacacttcagcaccatttaatgtgcggatagaaagcgagacagccgttttctataaaattccacgagtaactttctgggaatatgtcaatgaagataaaaaacttcaggattatattaatgcctactatagagaacaactttctcaggcaatctaccgccagcagcttatgacaatgaatggaaaaacaggagcggtatgtgcgtttttatacttgcagatagaaccatttggaaagaaaatgaaagacgggatacttattgactttcagattaccaatgatgatattgcaggattttgtggtatttctacacgaaatagtgtgaatcgtatcctgcgcggtttaagagaaaatggaattattttcatagctgaccagaagatacttataaaagacaaagaatatttagaacaatatgtaaagggctgactatggctgcttgacagagcatgcgaaatacttaataccggtaatttatatagaagaaaaagagattatcgctaagattcatgcaatgacaaaaacattagttgcttctattttagagaacgagaagccagtttatgtagattttgaaacacaggaaaggattccaaaagactctgcattatggtataaagaagttataaaaacaaatggggagtgtttgagtatcaatgatgacagaagagtataaagaggaatacaaaaaagcaagaaaagcagcaatgaagcagtatcgaacctgtgcatcaagaggttggtctttatatccaccggtgcttgatgaagtatccgcttatgtaaaaacagcaggtgaggaagtgcttggagaaatggaaataccactttcgcttgtgactgggacgagaactgcaggcagacagaatgccttcagtaaagattttcttccgattcttccagagaacagcgaatttgcaaggaagtggattacactttatgaggcgcagatggaagaggggattcgagacccgattttagtttatgaatttatgcatcagttttatgtgcaagagggaaataagcgagtcagtgttatgaagtatctcgatgcctcacacattatggcaaaggtaatccgaatttttccagaaaaaacagatgagccgtctgtaaagctttattatgaatttatagaattttatcgtagtacaaaattctatgatattgtttgtaaacaggtgggaaattatgcgaaactcctgaaatttatgggaaaggaacggaacgaagcttgcagtgatgaggaacggaagaagttacaaagccttttctatcatttttcttctatatataatgcagtcgcaggaaacgaagaagcagtgctgacggccggagatgcctttttaatctatctcaatattttttcttatgaagaggcagccagtaagccggcatcaaaacttcgggaagaaattcttaaaatgtggaaagagtttgttccagcaaaagaggcagagtcagtaaagcgtttgttagagccggaagaaaaaaaaccggcattttggaataagctactaaattccacccaaaagctttctattgcctttgtctatgataagaagccagatacatcaagctggttatatgcacatgaacttggcaggctacatcttgaggaagtctttccagaaaaagtagagacaagttgttatatcggagatgtggaacaggcagcggtcgatggaaatcaggtcatatttacgaccacacctcttttaatgccagaaagtttaaaagccgcattaaaatatccagaagtacagatacttaactgttctttgaactatgcgtggaagtcgattccaacctattatacgagaatgtatgaggtgaagtttttaaccgggctgattgcaggttctatggcaaagggagagaatatcggctacgaggcagattatccaatttatggaagtatcgccaatatcaatgcgtttgcgctcggtgtggcaatggtaaatccgaatattaagatttatctaaactggacttccgaaaaaggaaagcaaaaagcagcagttgaggaacttgcccttgtctccgccagagatatgatttctgctgacggatgtaatcggagattcggtctttattccaatgaaaatggtgaaatcctgaacatagctaccagtgttcttgattggggcattttctatgaaaaaatcatacagcagatgctagacggtacatggaaaaaggtatctgacaaagaaacagcgtcaagaaactactggtgggggctttctgccggagtagagaacctgatttgttcttcacagatgccttatggaacaaagcggcttgtagatacgtttcaaagtcttatcacagaaggacattttcatccttttgagggcatgttttatgacaaaaacggcagagaacacggcaaaaagaacacaatattaagtaatgaagaaattatcacaatggactggctgtttgccaatattgtaggagaaattcctgaaaaatacgagttaaaagaacaggcaaaaccaattgtagaacttcagggagtgaagggagaaaaagaatgaatatccttgtaattgcagacgaagaagcaccatctttatgggattactttcgtccggaaaaattgaaggatgtcgatttgattttatcctgcggagatttaaatccgaaatatctttcctttctggcaaccttttgtaaaggcccggtactctatgtacacggcaatcacgatgaccgttacgagaaaactccgcccgaggggtgcatttgcatagaagataaaatctatgaatataaaggcatccgtattatgggacttggtggttcctatcgttacagttcgggaatcaaccagtatacggaaagaaagatgcgaaaccgtatttttaaaatgtggtttccactctggcgaaagaaaggattcgatattcttctcacccatgcggcagcttacggagtagacgatgccaatgactgggcacatatggggttcgaatgttttgtgaaattattagatatataccgtccgaagtattatatacatggacatattcatttaaattatggcgggggacatacccgcagacagcaatacggcgagacagaaattattaacggatatcagtttcataaatttgaatatgaaacgggaaaagaaataaagatgttttaaagcgttttgcaaataggctttagagatatatgatgcaaaatgtaagagcaatatgtagcattttagtaagtaaaaaaatacataaatgccatagataaatttatcaagaaagcaatggggctgatcgacaagtatcatgttgattcaaaatatattatttttgagattacagaaaatacttatatacataatgtagaagcggttaatcgtatgattcagacatttcatcagagaggaatccgtatttccatggatgattttgattctggttattcttctttgaatacgttaaaagaaatcatatttgattaaaaggtggaaaataaaattaagttaaaaaagattttgagagtatagaataccatcaggaggtacatgaattatgttaaataatttttctatttctgaacgcaaagtagcaattatcggagcaggatttgtaggggcgtcaattgcctatgcgcttacaataagaaaacttgcacgagaaatcgttttaattgatatccatgaagaaaagacaattggtgaagctttagatatccagcatggaatcccagatatgggaatctcgtctgtgaaggcaggaaactatgaagactgtaaagattgtgacctgattatcattactgccggaagaaaccgaaaaccaggagagacccgccttgatcttattgcaggtaattcagcaattttaaaaaatgttgtagaccagatgaaaccgcattatacaaaaggtgttattatgattgtgagcaatccggtagacgttcttgtttatcagtgtacaaagtggatgggacttccgaatggaatggtttttggaacaggctgcattctggattcctctcgttttacccgcttaatcgcagattatactcgtctgaatacagaagtagtaaaagcaaccatcgtaggagaacatggagatgcccagattccaatctggagtcgtgtttcgattgccggtgtgcctatacaggaatattgtgagaatgtaggccttagatggggcgagaatatccgaaaagatattagtgataaagtgcgcgagatgggggcaacaatcattaagggaaagggcagaacacattatggaatcgcaacctgtgtctgttaccttgcagaagcggtgttaaatcagcgcctgactattgcaccagtctctacgatgttccagggggaatatggcatagaagatgtctgcctcagtgttccttcgattataggagtaaatggagtagaaaaacgtcttgaagagcggtgggcagaggaagaatttcttgcattccgtcaggcagctgagaaaatgaggaatgtcttaaaaacgctgtaaacttgtacgaaggtgtgataatatagtagagaaactataagataataatgtcatattataatatagattgaatagcatgcttataatatgagataggaggaaccgatgagagtagcaagtgattttagagaattagcaagaagggctctttcagggaaatgggggtcagcggtgcttactacattagtagcatcaattcttggtgcggatattatggtgaacggtggttcaggcacatcaggtattaccaactcagtaacgaacgtggtgaaccgtggaaatggagacggttcttataatgggattttatccacgatgtcgattacttcattaacctatattttaggagctatgatggcaatagtcactgttttgattgttgttggactagtacagtatgttataggaagttttgtttccctcggattaatccagtataaccttgatttgatcgacggaaaagatgtagaatttggtcagattttttcaaaggcatccatgtttggtaaggcattctggctcagacttcgaatgggtatctttacctttttgtggacattattattaatcattccaggaatcattaaatcctatgcctacagtatgtcaggatttattatggcagagaatccggaaatgacagcaaaagaagcgatgcaggtttctgaaaaaatgatggcaggaaacaaatggagactgttctgcctgcaatttagcttcattggctggcagattctttgtatcctcagtttgggaatcggcttcttgtggctgacaccatatatgaatgcggcaacagcagcgttctatgacgaaatctccagagaaccgttaaattaactcctgatttgccgagctggcgaggcagacggaacagacgaactcctgaaggtaaataaagcatatttgtgactttagtcgcggcggtttgaatactcgcttacacccgctcgtatccaaaccttgctccgaggccacaaatatgctttatttatcttcaggagttctgctcgttggcagctcagaaaatcagttagagggatttggggaagaggacaggaaatgtagaagttccgggaaatgaaattttataggattgacacttgaagtagtgccacaatcgtatagttatttatggtcactacttttttctattaactagagcgtgtttgaaaaaccattcctacaatctgcacgccccaatttgcggtaaaaatgctaaagaaagcaaaaaagttataaggagaatggataaagcccggaaatctttccaagatagttataatatcaaataatttaaaatgataagataagtgtcagtcctccagtatttcaattcctcaaaaggtcacaacagtctgaagcctccctcaaatctttctcaaaataaatcctgaatttgcttaggcagccaaaacacagcccacagggaatataatatcctatatttgtggcctcggagcaagtgttggatacgagcgaatagagcgagtattcaacatgccgcgactaaagtcacaaatataggatattatattccctgtgggcgtctcctttgctgcgcaaatcaggatttattcattttctctaggcgttctaaaatgagctgctcaatatattgtggtggttttcgttctccttcttcccatgccaaccatgtctttagtgggaaaccgagaagttttgctatttcttcagcggggcgatttgtttttgttcttgcttctttaattgtcataaaagtacctttctattacaaaaaaataacggaaatagttcagatatttttttgcgaaatttcatttatttaaaattactatactgttgtaaagcttttttgtcaaataaaagtctagagcatgtttgaaaaatcattcctgcaaattgtgacgcacattttgcagaaagcatttttcaaacacgctctggtgtgttaattataaaaagtataattatggaataaaatccttaaaaagtataaattctagtttgagtagaataaaagcaagaaaagtcttgttataaaagaaaaatgatggataaatgttataaaatggataaaaatctataggataccagatttttgtggattagtacagataattaattgcttaaatataaaataaaaccatttatttaagatagtattatgcaaaaactaaatataaaaaatatctgtcgtttacaaataattccattccaaatttttcttattctggtataataatgccataaacacagaaacaaataaaggtttttgttagaaaggaattaagaaatatggaaagaatacttaaaaacgaaagaagggttgagggagattgtaagagatatttgttgagatatacgcttgtatcgaatggatttccaaaagaagagggagaaggaatatattatggaattataacagaacaatttgtatggactgatgaagaggaaagatgggaagcacaagatacagctcaggttaaaggtttttctgaatcgttagaggagtctatggcattttttgaaaagatggttcaaggggaagttatgccagtatcacttaatgagattgttgatgactggaaaagtgcgttttatatgggaaggaaagaatcggcataagatttcatttattgtaaatcttgtatctatagtattatgtcatatatgttttctttgtagaataggatgagatagaataagagaaagaaaaggtaccactgagatattcttctatggtataattaaaatattaatattaaaattatattatagggaataggaggtgtcttatgattaggcacaaggcagtttaccgcgggggaagcggagagattgtagagaagaaatcaagatttattgctaatataaagagtgtagaaactgtagaagaagcacaggtttatatagaagagatgaagaagaagtactgggatgccaggcataattgctctgcattttctgtaggaactgaacaggtgacaacaagatgcagcgatgatggggaaccaagtggaacagcaggtaagcctattttggaggtaatatctggaagtgggattcacaatattgttgtggtagtaaccagatattttgggggaacgctgcttggaacaggaggacttgtaagggcgtatacagatgctacaagagcaggtattgagaattctgatattgtagagaagattccaggaagaagagtggatatagccatggattatacagatttaggaaaactacaatatatgttagcgcaaaatgaagtgcttactgaagatacagaatatacggataaggttattattcatgctttatttccggaatcagataaagagaagttaaagaagaagattacagaagcgacaagtggacgtgtgatgacacaggaaggggaagaagtgtactttggtacagtggatggagaagtgattgtattttaaaaaattagttgggatccccagcgattcaattaccagatatttcacaaagcgtagaataggatgtggtttgtgtaatataagataaaatataaagaatatttttcttacataaaaatactccagaagataagaaatatatatatcttctggagtatagataatagcttgttttataaatgaatatattaagcttttccgtttctctttgcacggtaacgggcagttgggtcaagaattttctttctgatacgaatgttctttggtgtgatttcaagaagttcgtcagtatcaatgaagtctaatgcctgttccaggcttaagattctaggagggcttaactttaaggcatcatcagaacctgaagcacgagtgtttgtaagtttctttgttttacatacatttacctcgatatcatccgttttaccattctgaccgataaccataccagagtatactttttcgccaggccctacaaataatgtaccacgttcctgtgcgctgaaaagtccataagtaactgtttcaccagattcgtaagcaattaaggaaccctgctttctgtattggatgtctcccttatatgggccatatccctcaaataatgtattgatgatacctgttccttttgtgtctgtcataaagtcgccacgatatccaattagtcctctggaaggaatggagaattccagacgggtagaaccagtaccagacatggacatattacgaagttcacctttacgctggcttaacttttcgataacaacaccggagaattcttctggaacatcgataacagcagtttccataggctctaactttttaccattttcatctgtgtggtaaagaacttcggctttacttacagcaaactcataaccctcacggcgcatattttcgataaggacagaaagatgaagttctccacggccagataccttaaaagaatcagtattttccatctcctcaacacgcagactgacatctgtgttaagttcacggaacagtctgtcacggatgtggcgggaagttacgaacttaccttcctgaccggcgagtggactgtcgtttacaaggaactgcatagcaattgtaggttccgaaatcttctggaatggaataggttctggatgatcaggtgagcagattgtgtcaccgatatgaatatctgcaataccagaaatagcaacgatagaaccaacagtagcatcatttacttctactttattaagaccatcaaattcataaagcttgctgatttttacttttttatttacggatggatcatgatggtttacaaggagagcatcctgattaacacgaatagaaccattctctactttaccgataccgattcggccaacatactcattatagtcgattgtactgataagaatttgtgtatctgcatcagggtcaccagttggagctgggatatgcttgataatggtttcgaataacggtttcatatctgtaccattttcgcttaattcaagcatggcaataccggatttagcagatgcatatacaaaaggactgtctaactgttcatcgtctgcatctaactctaaaagaagttccaatacttcatccataacttcttctggacgagcttccggacggtcaattttattaatacatacgatgaatggaagatttaattctaaggctttttttgttacaaactttgtctgtggcattggaccctcaaatgcatcgacaacaagaattacaccatcaaccatttttaatacacgttctacttcaccaccgaagtctgcgtggccaggagtgtcaacgatgttgatttttactccttcgtagtggatggctgtatttttagataaaattgtgattcctctttctttttcaatatcgttggaatccataacgcgttcgccgacttcctggttggcacggaaagtaccgctctgctttaagagttcatcgacgagagtagtttttccgtggtctacgtgagcaatgattgccacgttacggacatcttctcttgagattttcataaattgccttctttctaaaagtgtaaagtataaattgctcatcacttgtggaatgaaccaatttataaccgtatattgacgtttaaactaggttattctagcacaaagaaagaaaagacacaataaaaaatacgaaataaaaaggaaaataaacagaaaaataaatagaaagaaataattttaatctataaaaaatctataaagaatatgaaaaaagatagcagaaattattagggaatttaaataaaaaggaatatttttttttaaagtgagtatatataaagtaaataacatatacagaatctgctacatacaggggaggagtaaacatgacagaaaaaattttaaaaaataaccaggcagtagttgcaggagaaattatctctgattttgaatttagccatgaggtttttggcgaaggcttctattttgtaaaattaaaagtgagcagactcagtcattcaagtgatattattccactgctggtctcagaacgtcttattgatgtgagccagtctcatatcggccagtttttagaagctcgtggccagttcagatcttataataagcatgaaaataatcgcaatcaccttgttttatctttgtttgtaagagaactggaattaatagactcggtagaaaatagaaaacctaatatgatttttcttgatggatatatctgcaaggagccagtatatagaacaacaccgttaggaagagagatcgcggacgtacttctggcggtgaacagagcatatggcaagtcggattatattccatgtatatgttgggacgtaatgccagatatgcaggaaatctttcagtaggaagccgaattcagctatggggaagaattcagagcagagaatatcagaagcgcgtaggagagaataatgtggttagcagagtagcatatgaaatttctgtaaataagatggaatatattgatgatggaataaaccttgaaaggaaggttgcagattcgggaaatataggttaaattataagggactgttcgttttgagcagtcctttggtttatcattatgtaactttcagagtcatatggatttttggtaaataagtgaattatggttacttgcagtcagattgctgtttggcagggatatgaattatatctattatagataattatggataaatacatttttaaaatttatataggagggtaaccgcgggaataaaaatagaatcaaagatacgttttggttttggtttctgaatagtcacatcatatgatataatgtagaacaagtaagaataaaagtatagaaaggaaaacgaaaatgaagataacaccagtaaaaggtacgaatgattatttaccagcgcaggctgagcttagaaactatttacagaagaaaatctgtgagacatatgagcaggctggtttccaaagaattgcaactccaattatcgaggatattgagaatcttgataagagcgagggtggagataacttaaatcttattttcaaagtaatgaaaagaggggagaagttaaagaaagcaatcgcaagccagaatccagataatattgcagatatgggactccgctatgatcttacattaccactgagtcgttattatgcgaataatcgtgcatctttaccacagccatttaaggtgattcagatggatagagtatatcgtgcagaacgtccacagaaaggccgtttgagagagtttatccagtgtgatattgatattcttggatctgattcttctacttgtgaaattgagttaatccacacaaccgcaaaggctcttcttaatattggtattaataactttaaggtaaaaattaatgatagaagaattttacgagaaattcttttgtctgtaggatttgaggaagaccagttagacagcgtatgtatttcttttgataagttaaataagatcaaggcagaaggtgtcgaggcagaattaacagagaagggatttgataaggcagttatcgcagaattcatgaaacttctttccaatgcaccatttacacttgactatgtaaaagaaatctgcaaaaacagtgaatatgtagattctctcgcatatattattgatacctctaatgcgctcgctgatggcaaatatgttgcagaatatgatatgaccttagttcgtggacagggatattatacaggaacagtatttgaagtagaatccttagattttaacagctctattgctggcggtggaagatacgataacttaatcggaaagttcttaaaagaacagattccggcagtaggattttccattggttttgagagaatttacagtattctcatggaaaaagaatcttacaatacagaaaaacagaaaaaagttgtcttaatttatgaagaggatcaggttgcagatgctatccgttatgcagaagaactccgcaaaacttataagacagcattatacatcaaaccaaagaaacttggtaagttccttaataaattagaagaacagggatttgacggttttcaggtgtttggcagagacgaagaagtaagaatgtttggagaacagtagatttttgtaatgatttatggtatgatgttgcaaaacatcaacaaatataatcaggatgaaaggtcagaaaatggacggaagtatacaggtttattacggcaatggaagaggaaagaccacagcggctcttggacttggcattcgtgcagcaggtgtaggaaagcaggttatcatggtgcagtttctcaagaaaaagcattctgatacgcttgatttcttaaaaaagcttgagccggagcttcagattttccgctttgaaaaggcggcatgtgggtattctgatttaagcccgaaggaaaagcaggagcaaatgctcaatattaagaacgctcttggatatagcagaaaggttcttgataccggacagtgtgatttgctgattctcgatgaaatctttggattagttgattacaatataattaccattgaggaattgatggatttaattgcagtgaaaaaagattccatggacttgatacttacgggaaggaatctccccgatgaagtgagggagattgcggactgtgtctattcaatccaaagagagaaagaaaagaccccggagatattagcacaggggaatttctagtaatgcattcttagattagagaaaggaaggataagtatggctgtttttacaggagcaggtgttgcaatcgcaactccatttgatgagaattacaatattgattatgagagttttgggaagtttatagatttccagatagagaacaagacagatgcgattatcgtttgtggaacatctggagaggcttctacattaagtcatgaagaacatatcgcagcaattcgttactgcgtaaaccgtgtgaataagagagttcctgtaattgcaggaacaggttctaattgcacagatactgcatcttacctcacaaagcaggcgcagaatgcaggggcagacgcagcgcttgtagtaactccttactacaataaggcaacacagaacggtctgattgctcattatacagatattgcaaaacatacagatttaccaatcattctttataatgtaccaagcagaacaggctgtaagttagaagctgctacaattgcaaaattagtaaaagatgtagataacatcgttggtgtaaaggaagcaacaggagacattgcttttgcaacacagattatgtacgatacacagggagatattgatatgtattctggtaatgatgacatgattgtgccaatgttatctatcggtggtaagggtgttatttctgttctttctaacgtagcgccagaagatacacataatatctgtgcagaatattttgcaggtaacgtagaaaagagtcgtgaattacagattaaatatcttgaactgattcattcccttttctgtgaagtgaatccaatccctgtaaagaaggcattagagctgatgggattttacggcggtaacgtaagacttccgctgacgcagttagagcctgcacatacagaacgcctgaaaaaggctatgattgagactggaattttagcataaatataattttttagaattatgctaaatatatctcacaactaacctattatgaggtgaataattaagttagtaaagtgagtccagactttgaatagttactttagttttgataattaaaacatatccggaggattgaacataagatggttaaagtaatgatgtacggatgtaatggctatatgggtcatgttatctgtaatttgataaaagatatggagaatgtcactgtggcagcgggaattgacccatgtccaggtgaccagaaggattttcctgtatttgcatccttagacgaatgtaatgtagacgtagacgttatcattgatttctctgcagcagtagcagtagatggcgttcttgattatgcagcagcaaagaagattcctttagtagagtgtacaacagatctctctgaagaacagcttgcacatcttgaagaagccagcaagcagacagcaattcttcgttctgcaaatatgtcacttggcgtaaatacattattagagatggtaaagactgccgcaaagattcttggcgaagcaggctttgatattgatattgtagagaaacatcaccgcagaaagttagatgctccatcaggaacagcattagcttttgcagattctatcaatgaagcagcagatggcaagtataactatgtatttgacagaagcgagagaagaatgcagcgcccacaggatgagattggtatttctgccgttcgtggtggaacaatcgtaggtgaacatgagattatcttcgcaggaacggatgaagtaatcgagtttaagcacactgcatattccagagctgtatttggaaaaggtgctgtagaagctgcggtatatctggcagataaaccagcgggattatacgatatgaaagatgtaatttccgcaaaataaattctggtttgccgcaggcaagaaagacgaacccagaaagataaataaagcatatttgtgactttagtcgtggcaggttgaatgttcgcgtgaaaacgctcgcattcaacctttgctccgaggtcacaaatgtgctttatttatctttctgggttctgtttgttggtaataaacatactccagaatttcaactcctcaaaaagccacaaccgtttgaaatctccctcaaatcttcctcaaatcttccctccaaaataaattcttccttttccctaaccccaacgtacagtctacaataacttaaagttttttctaaatctgggtttttattggttgttttttttcagaaagcagaagtccttttttgtaaagtgattggatttttttgctgtaccattgacagaaacgaaagcacataatatactctaacacaaaagtcttaatttcaaaaataagataaataattacgtttgaaatcaaaaaatatatatgaagtgaaatgtatatagcacaggaaaagaactgtaagtgaaaacttgcataaaaacaggagggttagggttatgtcaggaaaggtaaacgtaaaaaagtttagaaaagttcttgttgcgaatcgtggggagattgcgattcgtattttcagagcgttaagtgagcttgggattacaacggttagtatttattcaaaagaagaccgttatgcaatgtttcgttctaaggcggatgagtcctatccgttaaatcctcagaagggaccgattgatgcatatcttgatattgatacgattattaagatcgcactttctacaggagtagatgcgattcatccgggatatggatttctttcagaaaatccagactttgcagatgcatgtgagagaaatggaatcgtatttattggaccgggcagcaatattatgaatgcgatgggagataagatttcttctaaaaagattgctattgaagcaaatgttccgattattccgggtgtggattatgcgattaaggaagtagatgaagcgaaaaaaattgcagcgcaggttggttatccggttatgcttaaagcgagcaacggcggtggcggacgcggtatgcgaatcgtaaatagagaagaggatttggagaaagaatttaacgaagcgaagaatgaatcgaagaaggctttcggtgatgatatgatcttcattgaaaagtatttaaaagggccaaagcatatcgaggtacagattgttggagataattatggaaatgtggtacatctttatgacagagattgttctgttcagagaagacatcagaaggtagtagagtatgcaccggcattttccataccggaaacagtacgtcaggaaatctttgatgcttctatccgattggcgaaaacagtaggttatcgtaatgccggtacgttggaatttttggtagatgcagataatcatccatattttattgagatgaatcctcgaattcaggtagagcatacagtaagtgagatggttacggatattgacatcgtacagacacagattcttattgcagaaggttatcctttagcttcggaagagattgcgattccatcacaggaaagtgtaacctgtaccggttattcgattcagactcgtgtgacgacagaagatccagctaataatttccttccggatacaggagaaattacagtatatcgttcgggttctggtaatggcatccgtcttgatggaggcaatgcatatacaggagcagtgatttctccatattatgacagccttcttgtaaaagcaatctctcatgacagaacttttcttggagcggtaagaaagtctatccgagctttacaggaaatgcgtattcgtggagtaaaaacgaatattccatttcttgtgaatgtgttaaatcatccaacatttcaaagtgggcagtgttatacaacgtttattgaggaaacaccggaactttttgaacttactaagagtcagaatcgtgcgaataagattattgaatttattggggatcgcatcgtaaattcaaataatggagaaaaaccattttatgagaacagagtgcttccgaagcttgacaaaagcaaaccggtttatggagcgagggatgaatttttaaaattgggtgcacagggatttatgcagaagattttaaaagaagataagctttatgtgacggataccacaatgcgagatgcgcagcagtcactgatggcaactcgtatgagaagtaaggatctgtgtggtgcggcttatgcgacaaacgcgtttatgcagaatgcattttctgtggaagcgtggggtggtgctacctatgatacggcatatcgctttttgaaagaatccccttggaaacgtcttgagttattaagagaaagaatgccaaatacattgattcagatgcttcttcgtgcatccaatgcagtgggatacagcaactatccagataatgttgtaaaagaatttatccgtatctcagcggatcatggtattgatgttttccgtatttttgacagtttaaactgggtggaaaatatgaagatgccaatagaagaagcgctgaaaacaggaaaaattgttgagggaaccatttgttatacaggagatgtcagcaatccaaatgagacaaaatatacacttgattattatgtaaaaatggctcttgaattagaaaaactcggatgtcattccattgctattaaagatatggcggcacttttaaaacctagagcggctaaagaacttgtaggcacattgaaaaaagaacttcatgtaccattacatttacatacacatgattctacaggtaatggtgtgagtacagtgctcatggcagcggaggcaggagtggacatcgttgacttagcgattgaatctatgtcatcgatgacaagtcagccatccatgaatgcagttgtagaagcgcttcgcggaacaaagagagatacagggcttgattttgaagagttgtcagaactgagcagatattataatcgaattagaagtgtgtatgcaccatttgaaagtgatatgaagtctccgaatacggagatttataaatatgagatcccaggtggacaatattctaatcttcttgcgcaggttacagaaatgggatctccggaagaatttgaggcgatcaaagggctttataaagaagcgaatgatttgcttggtaatattgtaaaagtaacccctacttcaaaagcggtaggtgatcttgcaattttcatgtataaaaataatctgaataaggataatattttaactgccggagctagtctgtcttatccagattccgttgtttcttatttccggggaatgatgggacagccttatggtggattcccgaaagaattacagaaaattgtgttaaaagatattgaaccgcttacagaacgcccaggtaaattgttgccgccagaagatttggaaggtatcaaaaagcacctcattgaaaaataccattatgaggataaatcagaagaagttatggcacaaaaagcaatcagctatgccttgtatccgaaggtatatgaagattactgcgaacattttgaaatgtataatgatgtaacacgattagaaagtcatgtgtatttctacggtctgcgaaaaggagaggaaacttatcttaaaattggcgaaggaaaagagcttctgatcaaatatcttgaacagagcgacccggatgaaaatggaatccgaacattaagttttcaggtaaatggttctattcgtactgtgaagattcaggatcataatcttgaaattaagacagaccgccgcttaaaagcagataaaaataatccacagcatcttggttcctctattccaggaacggtagataaagttcttgtaaaggaaggagatgtggtaacaaagaatatgccgcttatgacgattgaggcaatgaagatggaaacaacagtagtatccacagtgaacggaactgtagataaaatttatgtggaagcgggagacagtgtgcatcaagatgatttattagtatcttttcatattaaagaatgattttacgagtgatgatgcctattcttcctcttgttcgtgtaccaaatgtatataagcttactaagatggcaaaaataacctcagccgcaatcgttgaaattagcggttggggttatttttattatagttataaaaatgatgctggcctcaaaagatatttcttaaacataatgctccccagccaattttttcattaggatattccgaaaaagcaggtaagggtcttgcgcttttccagagatatgcttttgctttttcaccatagagaaaagggtcgttaccatttacaatgccatgttgcatcaaaagtgccgcagctccagtaacaaaaggagcagccatagaggtcccggtccgtatagtgtacccgccaccaggagcagtgcttaaaatattaactgccggggcgcaaaggtcgggttttgtgtgcctgttattagaaaatccctgcccggaaaatggagcaaatacatcaaggctgctatcgtagccgctaacgctgataacagaagaggcagtagaaggaattgtaaatgtcatatcagaagaagggacgagaaaaccggtagcagaatttgtagcttcttttgatggcagccaaaattgtaagcgtccatcaacaattttgccagttggagtggattcaatgtgtaatgcccaagtgccggaagtgataaaagtagtatttgagctaaaggaaagaaaatactgtcgaaatggctgataaggtgttggattgttgatcgtaagataaatagttgtgtcagcgatcatataggcgtagatgccgggaacggcaggaaagacaaaactttccaaaccggaaggggaaaaaagttcatagaaaaaattatctgcgaaagtctgccatatttcaaggtaaagacttcgctcgcccggagctatggtaaaatctatagatttatcataagtgttttgatttgaaattgtgtttaaggaagcgtgccttctggtaagaccttcatttcctgtagcagcacaaataacatttttcccataaagagaaacttgctccataaaaagttctaaaagactactcccagtatgtgaaccatcattagaaccataactgatattgatacttaaaggcaaagaacgcgaattagcaaaacgaaccgcaaaatcaaccgccatcataagatttgcataatccgtataaacagaagcggtctcgttttttaactttacaacaattaaagaactttcgggcgcaaccccctgactatttccattgctggcacgcccgtttcctgagcagatacctgcgatatgagtgccatgcccggaaacgtcttcggaaggcgatagtagctcggtaacagggtcagttacagaaaaagtagaagagtcagaaggaacagaactagatttcggcataagtaatcggtttaaatcttcttctgaaaaaataacacctaaattataagggttatctgtagcggagctatgcttggaaacattattccttctggtgttagttctattgtctgctgcgatataattgttttgactatttgttgtactaatgtattggaagttatcactattagaactattgctattagtattttctttattaaaagaagcaaaaggcaaactctgatcccaataagccaaaatcctcgtacttccatccacatttcgaaaatcaggatgcctgtaatctaccccggaatcaagaacagcaatcgctgtccctttgccagtaagtgttgtagcatttacatttcttccagtcacaatattataatcaggaaaacacgaagcatcaattcctgtaagcgcattttcataaatcggacgagaaagttccacataaagaacttgaggaaaagtcaaaaaagaaggaatatccttctctttaataaaaagaatcgcaaaattgccaagcaaaggaataaaagaaaaagaaatcatttccttaatttcctcaagagaaccattataaaataaaatcaacttccacatatccgtacttggagaaaaaccagaatgcagcagagaactttccatccgcttggcattatccaaagaaagcgagagtgcaagctcaggatttagcttctggtttatttgttcgatttctgtaatagaaagcataacgtcactacctactctgcttcaaatttctcaaaacaaatatattcgctgagttactatttaattcattagacaaactacagacgaagccattgcccccaataaggcatatttgtgattttagtcgcggcgcgttgaatgttcgctccacgcgctcgcatccaacacttgctccgagaccacaaatatgccttattgggggcaatggattctgtgctgtggctggagaaggtgaattaaacaggggaggggatttggggacagaagctgatgtcttctgcttactctagaatgactgggaatagagggatgagttggcttttttaacgattatcacatcaatatttcaataatttcagaacaaaaagcagtctgttgttatcaatctcaactcattactacttccatttaaatacaaaatatctattcacaaaattctgagagcaagcagaaaacttttaccttctcccccaaatccccgcaaccactatttaatttaatcaaaattcagctaaagacagcccgagaagagaaccgataccctatatttgtggcctcggagcaaggtttagatgcgagcgcataaagcaagcatttaaaccgccgcgactaaagtcacaaatatagggtatcggttctcttcctgggcgtctgtctcttaatgaattaaatagaaaaatgtgctatagtggagtatatttgatataaataaaggatggacaaaattatgaaagcagtattacaagtagtcacccacgccaccgtccgagtagacggcggcatcactggtcagattggcccaggattattagtttttctcggtgtagcagaagaagacgaacaggcagatcttgataaaattgtaaagaaagttacggaacttcgaatctttaaagatgatgcaggaaagacgaacctttcccttcaggatgtgaatggagaacttttgatagtttctcagtttaccttacttgcggattgtaaaaaaggaagaagaccaagttttgtaaaagcgggaaacccacagaaggcagaagaaatgtatgaggagtttatacgagtatgtaaggaaaaagtgccgaaggtagaacatggtgtttttggagcggatatgaaggtagaattgttaaatgatggtccgtttacgatagttttagacagtaaagagttgtaaaaaaatgaattgtcagacaaaaaaacttgcattttgtatgtgctttactatataataacgaatagcaggttttgaagaataatttgctgttttaggaaattaagtgagaagtctgggtaatggcattctagataaagcaagttccaggagcttcacaagttcaaatgaatgaaatgcaaataattgagtgatatggaagggagatatacaatggataagattaagatgacaactccattagtggagatggatggagacgagatgaccagaattctctggaagatgattaaggatgagcttctgcttccttttattgatttaaagacagagtattatgatcttggtcttgaatacagagatgagacaaatgaccaggttacagtagattctgcattggcagctaagaagtatggggtagcggttaaatgtgctaccattactccaaatgcagcccgtgtaaaagaatataatttaaaagaaatgtacaagagtcctaacggaaccattcgtgcaatattagatggtacagtatttcgtgcgccaatcgtagtaaagggaatcgagcctactgtaaagacatggaagaagccaatcacgatcgcaagacatgcttatggagatgtttataaagcttctgagatgaagattcctgggaaaggtaaggcagagattgtatatactgcagaagacggaacggaaacaagagagctgattcatgaatttgatggtcctggtatcgtacagggaatgcataacctgaatggttctatcgacagttttgcgagatcttgttttaattatgcattagaaacccatcaggatttatggtttgcgacaaaggatacaatttctaagaagtacgaccatacatttaaggatatcttccaggatatttacgatgcggattataaagagaagttcgaggaagctggtatcgaatatttctatacattaattgatgatgcggttgccagagttatccgttctgaaggtggatatatctgggcttgtaagaactacgatggagacgtaatgagtgatatggttgcgactgcatttggttctcttgcaatgatgacttccgtacttgttgcaccagacggaacaacagaatacgaggcagcacacggtacagtacagagacattattacaaacatttaaaaggtgaagaaacttctacaaactctgttgcaactatttttgcatggtcaggagctcttagaaagcgtggtaagttagacggaattgatgagttagtgacatttgcagataagttagaaaaagcaacgattgatacaattgagagcggaacaatgacaaaagacttagcattaatcacaactttagaaaatgtaaacacagtaaacagcgaagactttattaaagcaatccgcgctactttagagaatcttttaaatgcctaagggtgtttgaaagatcatttccacaaattgtaacgcatatctgcagaaagcatttttcaaacaagctcgagtagaaaaggtattgtaatttgcggaaaaataagttatatatagtaagatacattttgcacatgatttattgcatgagttacggatagatttatatgtaatccgtttggtgatttgtaatccaatataataaaaaccatggtatcctgaattgatatagaatgtaacaacgaagaataccgtggttttatgttgtaaataacaaagagaaaatagtagaaaagaggtagactatggattttcagcctgtaaaggcaagtgataaagagattattgataaatatatgaaaaaggcaaattctcgaagctgcgatatgtcttttgccgcagtatatctgtggaaagacttttatttattagagtatacagtgtgtgaagatatgctgattttccgcacaacggaagatggcagcagttacagctttccgataggggatgccagcccggaaaaggctttgcttgcattagaggcacattgtaaggaaaatgaagagcctttaaagctacattgtgtatacagagagaatgaggcatggcttgaagaacacatgccaggaaagtttgaaatcgaatttgacagggatagtgcagattatatttatgaatgtgagaagctgattgggttaaaaggaaagaaatttcatggaaaaaagaatcatgttaataaatttataaagacttatgactgggcttatgaaaaaataactgatgataatattgatgattgtcttgcaatgttatataaatggaaagaaataaactgtgagccagggaatatagaaaaacatgcggaagcctgtgtttctgagaatgcattaagagaaagagaattccttgggttaaagggaggactgattcgtgcagacggagaagtggttgcttttgcagttggggagcagattaatgaggatacattggttgttcacattgaaaaagcattttctgaagtgccgggagcatatgcgattattaaccagcagtttttggtccatgaagcggatgggctgaagtatgtgaacagagaagatgatgtaggagagccaggacttagaaaggcaaaattatcctatcatccggaatttcttgtagaaaaaggttttgcaagattagagcgtgtttgaaaaatcattcctacaatctgcacgccccaatttgcgttatattttgccttcattcagttgacgtagcccgctacgctgccctcattcaggcgaaatctcccgcaaattgtaacgcacatcttgcagaaagcatttttcaaacacgctctagtttaaaaatattgataattgttttgaaaatagaaagaaatctgaatattaactggatggtaaggcgtatttgaaaaactgccccggcaatttgtaagatacagtttgtagaaggggttttctaaaatgaaaaggaataaaaattcaaaagagttcccttgacaggaaaagaataaaaaggtatattaaaaaaaattaactggcaagggcgctggtcacaacgaaggaggtcattatgagacatttaatagatccgatggatttatctgtagaagaaattaatcatttattagatttagctgacgatattattcttcataaggagaagtatcaggaagtttgtaagcataagaaattagcgactttattttttgaaccaagtacaagaacccgacttagttttgaagctgccatgatggagcttggtggtaatgtacttggtttttcttctgccaattcctcttctgcctcaaagggagagagtgtttctgatacagtaagagttgtatcgggttatgcggatatcattgcaatgcgtcatccaaaggaaggtgcaccatacgcggcagcaagaaaactttctgtaccaattattaatgcaggtgatggtggacataaccatccaacacagactctgacagaccttatgacaatccgaagagaaaagggaaaacttgataatctgacaattggtatgtgtggagacttaaagtttggtcgtacagtgcattctttgattaaagcgatgtcccgttatgagaatattaattttattatgatttctccagaagagttacgtcttccagattatattatcaaagatgtttttgaaaagaaaaatatcaagtacaaggaagtacgcacaatggaagaagttatgccagagttagatattctttacatgacaagagttcagaaagaaagattctttaatgaggcagactatatccgcttaaaagatagctttatcttagatgagcgtaagttattagatgcgaaagaagacctttgcattatgcatccactgccacgagtaaatgagatttcaacaaaggtagatgatgacccacgtgcatgttacttcaagcaggcactgtatggtaagtatgtaagaatggcattaatcatgactttattgggggtaagcgcagatgaaaatagatagtattcagagtggaattgttcttgaccatattaaagcaggaaagagtatgcagatttacaaatatcttggtttggatgatcttgactgcagcgtagcaatcattaagaatgcttccagtaacaaaatgggaaagaaagatattatcaaaatcgcagataacatggatttaaatcttgatgttttaggatatattgatccggatatcacagtgtgctacataagagatggcaagattgttgagaagaaacatcttgaattaccagagaagatcgtgaatattgttcactgcaaaaatccaagatgtatcacttctgtagaacaggatttagatcaggtatttaaattgacagacagagaaaacagagtataccgttgtgcatactgcgaatcgaaaaaaagtgaatattaattcttaaggttctaaatgggaggtcacgcatgaatgtgtggcctctcttgcatattgtgacgatttggtgtacaattattctacttttattttattatatcttatgagaagcgtggtgagaaagtaatggaggcccagaaacaaaagttaaaacgaacacaaaaagaaatcagtaagccggaagatttcaccgatccggaagtcttatatgagaagttgataaataccattcgggaataccatccatctaccgacctctctatggtggaaaaggcatataaacttgccagagatgcacacaaggaccagaagaggaagtcgggagagccatatatcattcatccactctgcgtagcaatcattcttgcagagttagagcttgataaggagacaatcgtagctggaattcttcatgatgtagtagaagatactacggcaactcttgaagatttatccagagaatttaacgatgaagttgctctgttagttgatggtgtaacaaaactgggacaattatcttattctcacgacaagatggatctgcaagcggagaatttaaggaaaatgttccttgcaatggcaaaggatatccgtgttatcctgattaaactggcagaccgtctgcataatatgcgtactctgcagtatatgagaccggagaagcaaaaggaaaaagccagagagacgatggacatttatgctccaatcgctcacagacttggtatttccaaaataaagacagagctggatgacctgtctttaaaatatctgcagccggaagtttacaaagacttggaggaaaagctccagacaaataaggaaggcagagagaactttattcagtcgattattgatgaagtcagcaagcatattgaggaagcgggaatccgggcagagattgacggaagagtgaagcatttattcagcatttataaaaagatgcgtaatcaaaataagacactcgaccagatttatgatattttcgcagtaagaatcaaggtagacacagtaaaggactgctatgctgcgttaggtgtcattcacgagatgtataagccgattccgggaagatttaaggattatatcgcgatgccaaagcagaacatgtatcagtccttgcatacaacgctgattggttcttctggaacaccttttgagattcagattcgtacctttgagatgcatcgtaccgccgaatatggtatcgcggcgcactggaagtacaaagaaggcggcggcaacattaataaagaagaagagaagttaagctggcttcgccagattcttgagtggcagcaggatatgtcggataacaaagagtttttaacgatgttaaagaccgacctggatttatttacagagcaggtatactgctttactccacagggagatgttaagacgttgccggcaggctccacaccgattgattttgcttatatgatccatacagcagtcggcaataagatggttggtgccagagtcaacggccgtcaggtgccgattgattataagctgcagaatggtgaccgcgttacaatcgttacttcccagaattcaaatggcccaagccgtgactggctgtctatcgtaaagagttctcaggcgaagacgaagattaatcagtggtttaagacgcagtttaaagaggagaatatctcaaagggtaaggaattacttgaccgttactgtaaggctaaggggcttgtgatgtctaagtatatgaagccagaataccagaaaaaatgtatgcacaagtatggactgaaaaactgggattccattctggcagcaatcggacatggcggattaaaggaaggccaggttattaataaacttgtcgaggaatatgacaaagagaatcggaaaaatctgacagaccaggatgcactcaatgaaattgaggaaaagaataaaacaaaagctgtcgagaaagcacgaagcaagtcaggaattactgtaagaggaatccatgatgtttcggtacgcttttctaaatgctgtagtccggttccaggagatgagattattggttttgtcacaagaggaagaggcatttctattcacagaacagactgcgtgaatattttaagtatgccggagggcgacagagcaagactcattgacgcagaatgggaagaagaagcagtagaaaaaggtggcgaactctacatgacagaaatctgtctgtatgcacataaccgtaccggaattttactggatatttctaaagtatttatggaactgaaagtagatatcaaatctgtgtcaacgagaacaagtaaacaggggttagcaacgatcgtactttctttcgaaattggaggaatcgacgatttaaatcatattattaaaaaacttcgaaacattgaaagtgttatcgatatagaaagaagtgctggttaaccagcggaggtatttatttatgggacagttaaaaatcgtttgtgcacagttaggaccaattgatacaaacacgtatattctaatggatgatgagattaaagaagcaattatcattgacccggcaggaagcccggaagaactgattaagtttttggaagatgaaggttattctttagatggggttcttcttacgcatggacaccatgatcatattggagcgttagaaggattaagagaacattatgatccgtggaagctgcgcgtatatgcagcaaaaccggaacaggaagttcttatggtaaaagattataatttaagcacgatgtttggagaaggctatacaacacatgccaatatgatgattgatgacaaacagatttttgaggtaacctcaaaacataagtgccagtgtttgtatacaccgggacatacacttggaagctgctgttactattttgcagaagaaggctggcttttctctggtgatactctttttgcaggaagtgttggaagaagtgattttcctaccggagatgcacaggcgcttttaaaatctcttaatcatgtagtgatgagactgccagatgaagtaatcgtatatccgggacatggcccatctactacaatcggagaagagagagaaacaaatccatttgtagaaagatagaaggaaaatgatttatttaatacagaatgaccgtgaatatgattatgatgtgcgcgcaatcgcattggcattttatgagcggacaaagattgtagaagttacaaaagaagaatttgaagagcaggaatgggagaaggatgaccttctcctcacgcttgtttatacaaaaaaacgtattcagggctggttaaaaggtaaagtaggaatagaaggaacagaagaaagagcagtttcggaggaagtagtctgtgactatgaagatcacaaaggcagccgtaatgctgtatgccgctttttataccgtttgtttgaaaagtatactggaagaagtctgccatgggggatgcttacaggaatccgtccgacgaagattattatgaagtggatggaggaagaaaaagattcggcaaagcttgaacagcgttttcgggaaacgtatctggctgacccgcaaaaagcgaacctttgccgcagagtggcgcagagggaaaaagtattattagagtcacgaccatttgagaaagagtatagcctgtatattggaattccattctgtccgacaacctgcctgtattgttcctttacttcatttccagtctctcgttttggagacaggatgagggcatatttagatgctttatataaggaacttgcctttgtggcaaaacatcatagagataaaaagctcaccacaatttatattggtggtggaacaccgactgctttagatgaagaatgcctgtcaaagttaatgaacatgattcatgaacttttcccagtagaagaaagtgaagaatttacggtagagtccggcagaccggatagtatcacaaaagaaaagttccgtattttaaaagaagcgggtgttacaaggatttctattaatccacagacgatgcatcaggagactcttgatttgattggcagggcacatactgtagaacagaccaaagaagcatttttacttgcaagggaatgtggatttgataatattaatatggatattattacaggacttcccggagaaagcctttcctatgttcatgaaactttagatgagatatttaaacttcgtccggaaagtctgacagtacattctttagcgataaaaagagcagcacatctgaatatcgagatggaaaaataccagggtatggtgaagggaagcaccaatgagatgcttcgacttgttgatgaatatgccagcaatatgggaatggaagcatactatatgtatcgccagaaaaatattccaggtaaccttgagaatatcggatattgtgttccagacaaagaatgtttatataatatcttgattatggaggaaaaacaggatattatttcctgtggggcaggagctagcagcaaatatgtatttgagcagggcagaattgaaagaacagagaatgtgaaaaatctggatcattatattaaccgaattgatgagatgattgaccgaaagaggaaatatctctagtgtactgactcattgacgaaatgtgaatgagacagcatactaaattaaaagaggaaatactatggcatttgattatgatgggacgcatgatttagagacttcgctgcaggattcttttggagaggcgattcttcatggggttgttgtcagtaatctggcatcatttgtggccagagagatggcactttcagaagaacagtgccataatcttgcgatagcgggaatgctgcatgatataggcaaattgcgtcttcgttcttatgtatatgaggaaaaagaggcaaaactgaatatagatgaacttagatatgtaagactgcatccttctttaggttatgccattttaaaagaacatggttatacaaaggagattttgacagcggtattatatcatcatgaaaatgcagatgggagcggttatcccaataacctgaaaggggaggagataccattaggagcccgcatacttcgtgtatgtgatgcgtttggtgcgctaattgccaatcgcccttatagaagtgcgttcgacattgaaactgcaatatctattatgattgaagaagtgaaaaactttgatatgagagtttttttaacttttcaaaaagtaactcagtcagaagatatgaaaaatatgctgacaagactggggatatcttaatatattattttactattttaggaggaaaataaaatggctgaatccatgaaaggattgaaacgatcccatagatgtacagaagtttccaacgagaatatcggggaaactgtcaccctgatgggatgggtacagaaaagaagaaatctgggaagtctgatttttgttgacttacgtgacagaagcggcttaatccagttatattttgatgaggagacaatcggtgaagaaggttttaaaaaagctgcctctttaagagctgaatttgttatcgctgtaaccggaactgtagaaaaacgaagcggagcagtgaatgaaaaccttgaaacaggagacatcgaagtgaaggtagacagcattcgtattttatccgaatctgagacaccgcctttcccaattgatgcagatatcacagtaaaagacgaactgcgtctgaaatatcgttttcttgatttaagacgtcccaatatccagaaaaacctcatgatgagaagcaaggtggcaacacttacaagacagttccttgctaatgaagggttcttagagattgagacacctatgcttacaagaagtacaccagagggagcaagagattatcttgtaccaagtcgtgtacatccaggaagtttctacgctctgccacagtcaccacagctctttaaacagcttttaatgtgctctggctatgaccgttacttccagcttgcaagatgtttccgtgatgaggatttacgagcagaccgtcagccggaatttacacagattgatatggagttatcttttgtagatgtagatgatgttattgatgtaaatgaaagactgcttgcatatttatttaagttatgtctgaatgaagaagtatctttaccaattcagcgtatgacatggcaggatgctatggactactatggttctgataaaccagatcttcgttttgacatgaagattcaggatgtatctgaacttgtaaaagactgtggatttggtgtatttacaggagcaatagaaaatggcggtatggttcgtgggctttgtgccaaaggacttggtgatgtttccagcaaaaagatgaaacacatcgaaaaaacagcaaaagattatggtgcaaaaggattagcttatattcagcttaaatccgatggaactgtaaaatgtccattctctaaatttatgtctgaggaagaacttcaggctctgattcaggctatgggtggagaaacaggagacttattagtatttgcagcagataagttcaaagttgtttgcgatgtacttggtgcgctccgtcttaaatttgcagaagaactgaatcttcttgacaaatccgaataccgctttgtatggatcacagaattcccattgcttgagtggtctgaggaagagaaccgttacacagcaatgcaccatccattcactatgcctatggaagaagatttagatatgattgacactgaaccgggcaaagtgcgtgcaaaagcttatgacatcgttttaaatggtacagaaatcggtggaggtagtgtcagaatccaccagaacgacattcaggagaaaatgttcgaatgtcttggtatttccaaagaacaggcacaggagaagtttggcttcctcttagaagcgttcaaatacggtgtaccaccacacgcagggcttgcatatggtcttgaccgccttgtaatgcttatgactaaggaagatactattagagacgttattgcgttccctaaagtaaaagatgcttcctgtctgcttacagatgctccgaatacggtggatgataaacagttagaagaactctgtttggaaatcgagattccggagaaggaatagtaatttgctgcaggcaagacagacgccctcagaaagataaaggagccctatttgtgactttagttgctgcaggtagaatgttcgcttaaagcgctcgcatccaacccgcagtgatagagtcataaatataaggtatctgcccactttgggagcgtcccctttgcctgcggaaattattattaaaaagtgcttgacgtaatggcttgcttgtgataatataatatccgttgcacatgagaaacacatttttgaaaagaaaatgtaactgatttgaaaagaaaattaaaaacttcttgacagattagaaatcatgtgttaatatataaaagttcgcatcgcagaaaacaaaatcttcgaaaaaaagatgaaaaagttgttttttgaaaaagttcttgacaagaatgaagtgatgtgataaaatataaaagctttcgtgaaaaaagaaagcttaaaaccttgataactgaataacaaaacaaccttgaacgttaattcaaatttcattcgggttttcctgagagtgatgtctgcagggaagtccatggaacagaacgaaagttcaaaacctaaataaacagtaaagacaggaaaagaaccagtggttctggaccttgatctgacatcttaaacattttatttgagagtttgatcctggctcaggatgaacgctggcggcgtgcctaacacatgcaagtcgaacgaagcaccttacttgattcttcggatgaaggtctggtgactgagtggcggacgggtgagtaacgcgtgggtaacctgccctgtacagggggataacagctggaaacggctgctaataccgcataagcgcacgaggagacatctccttgtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctgactgttactgacactgaggcacgaaagcgtggggagcaaacaggattagataccctggtagtccacgccgtaaacgatgaatactaggtgtcggggccgtataggcttcggtgccgccgctaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaacctttatggagggagctgtcgaaggtggagccggtaactggggtgaagtcgtaacaaggtagccgtatcggaaggtgcggctggatcacctcctttctaaggaagacaagtagagagttgttttgttattcagttaccaagtgaaaacttgataacgcccttccgggtggcgatgcgctcaggggacacacccgttcccatcccgaacacgatggttaagacctgagcggccgatggtactatgctggagacggcatgggagagcaggtggctgcccggttccttaaaaaatcttttgattgattttgaggggaccaagcaggtgtggcaatacggaagtggaagatgtaccttgaaaactgcacacagatagtttttcttaaaagaaaagcgacatcagatttctatgataagaaagaattgagactaaatcaattctcccaatagcaagtcgaaagacgaaacatgagttttaactcatacgccgaatgttctctacgctaggaggaacaggaggcagccatttcttaggaaatggacatacaaaggtcaagcgaagaagggcgcagggcggatgccttggcactgagagccgatgaaagacgtgataagctgcgataagcttcggggaggagcaaatatcctttgatccggagatctctgaatggggaaacccggctgtatggactacagtcatccataagtgaatccatagcttatggaagggaacccggggaactgaaacatctaagtacccggaggaagagaaagaaacatcgattccgtaagtagcggcgagcgaacgcggaagagcccaaaccgtgatgcgtgcatcgcggggttcggactgcataagggattcagtaacggcaggagaaggctttggaacagccggccagagagggtgagagccccgtatccgaagccagagctgacccggcaggatccagagtaccacgggacacgggaaaccctgtgggaacgagcggagaccactccgtaaggctaaatactactcagtgaccgatagcgtatagtactgtgaaggaaaggtgaaaagaaccccgggaggggagtgaaagagaacctgaaaccctgtgtctacaagctgtggaagtacttcttaagtacgaccgcgtactttttgtagaacggtccggcgagctgcgggtactggcaaggttaagcacttcaggtgcggagccgtagggaaaccaagtcttaagagggcgttttagtcagtacgtgcaggcccgaaaccgggtgacctatccatgtccaggttgaagccgccgtaaaaggcgatggaggaccgaacccacatccgttgaaaagggtggggatgaggtgtggatagcggagaaattccaatcgaacccggagatagctggttctcctcgaaatagctttagggctagcctcatacaagtctgccggaggtagagcactgaatttccgcgggggcgtcaaagcctaccaaagaatatcaaactccgaatgccggacagatggtgtatgggagtcagactgtacgagataagttggacagtcaaaagggaaagagcccagaccgccggctaaggtcccaaagtgggtgttaagtggaaaaggatgtgggatctctaagacaaccaggatgttggctcagaagcagccattcattaaaagagtgcgtaacagctcactggtcgagaggtcctgcgccgaaaatgtccggggctgaaacaccacaccgaagccgcggaacccgtaagggttggtagaggagcattcttaggggagcgaagcattaccgaaggggatgtggactgctaagaagagagaatgccggaatgagtagcgagagcaaggtgagaatccttgcggccgaatatccaaggtttccagagtaaagctgatctgctctgggtaagtcggggcctaaggagaggcagagatgcgtatccgatggacagcaggtttaagattcctgcaccccttgttatcagaactgcggggacacgggaagggaagcagagccgggaatggaaagcccggtgcaagcgaaggagtcgcagggttggaaaatccgccctgcatgagacgaaggcgtgatgcggagcgaaatgaagtagtgaagctgcggccccttcctgtcgagaaaagccgctatcgtgtagcaagggcccgtaccgtaaaccgacacaggtggatgaggagaggatcctaaggccggcgggagaagtgttgttaaggaactcggcaaaatgactccgtaacttcgggagaaggagtgctgcgcaagcagccgcagagaaatggcccaagcaactgtttagcaaaaacacaggtctatgcgaaaccggaaggtgaggtatatgggctgacgcctgcccggtgctggaaggttaaggggagagcttagcgcgagcgaaggtttgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacccgcgccaggacggaaagaccccatggagctttactccagcctgatactgggattcggtattgcatgtacaggataggtgggaggctgagaactcatggcgccagccgtgagggagccggtgttgggataccacccctgcagtactgggtttctaacctgcgcccgtgacccgggcgggggacaatgtcaggcggggagtttgactggggcggtcgcctccgaaagggtatcggaggcgctcaaaggtctcctcaggatggttggaaaccatccagagagtgcaaaggcagaaggaggcttgactgcgacaccgacgggtggagcaggtacgaaagtaggacttagtgatccggtggcataaagtgggattgccatcgctcaacggataaaagctaccctggggataacaggcttatcactcccaagagttcacatcgacggagtggtttggcacctcgatgtcggctcatcgcatcctggagctggagcaggttccaagggttgggctgttcgcccattaaagcggtacgcgagctgggttcagaacgtcgtgagacagttcggtccctatccggcgcgggcgcaggatatctgagaggagctgtccttagtacgagaggaccgggatggaccgtccgctggtggaccggttgtcatgccaatggcacggccgggtagccaagacgggaagggataaacgctgaaggcatctaagcgtgaagccccctcaagatgagatatccatactcgaaagagtgagagaccccttagagacgatgaggtagatagggcagagatggaagtgcagcgatgcatggagttgactgttactaatcggtcgaaagcttgaccttaaagagttattggaaattgaaaaaagtacttgcaaagttcaaagagatatgatataatgtgtgtggttttgagggtacataccttgaaattaaatataggggattggtcaaatggtatgataggggtctccaaaacctttggtgggagttcgattctctcatcccctgtactttaggagcttgaaaatctataaaaggttttcaagctcttttgttttgcccgaaaagggtaaatttatcccaaagaatatttccattggcatcaagatattcttcatcgacaagagaaaataccatttatattattaagaaaaaatagtgacagattttccgtatattcatatcatataatggtatatttataatttgcaaacagccaaaatgaaatatatattgaagaaaaatcaggagggttacaatgacagaggaagaaaaactatgaacaggcggtattgataaaaaaatattttggtttggtagggcaagatgtgtgtttgtgtcccggatttatgtgtgacaacggccaaaatattcatgtgggagatcaaagaacatcttggaataggcaaaccgattacgattggaaatgatgtatacagaatcttcaggaacagccgctgatttctatgaaccagaaatattccagttatcataatcttatccagtgttgcagtgactttggattcatgcctaatattgttctttgcacaatggaaaattcgttaatttatcgtttttgtcaagaaaagattggaattggcattgacgcagatgttcatcctgaaaaagaattgctggcaggtcttcgcaagatagaactttacgatgctattccgtggaaaattaatttggtctgccgtaaaaatacagttaacgataaagttatttccagacttcaagaaatctgctgcaatctggattaaattttaatgataggcgttcattccaaactatcccctttttgtccagttggtggaaatatcaaatatggcaatacgtgctgaactggtttccttcatgccatgccgaagccattttataacccagccatatatcaggtaagaaaaagcagacataacataatctattggtgccggcataaattatacttgtctgagtggaaaggctgctatgaaaccgagaagctgatataataaaacaggtgaaatcttaatcgaaagaaggagaatatttatgaaacttaatcgttttgaagttgtgacaggaagatatattgaagagattccaggtcaatcccgtatcggatatgcaatgagtgatacaacagacttttatgatatgattgaatggtcaaaaaaaggtgggtatcaaggttcaactatttctttttatgattacaataatggtaaagtttatgaaccatttcaaaaacagagaaatgtgttatatggaactcctgtttatttaaagaaatctttttggtttttacagggagattataatagtgggaaaattactcttttcaaatattatccagataaaaatccagagatgattatacaacttaatatagaagatgtggatctttataatctacgtattattggagaggatgtttacattgtaagtgaggatgacgaatttgtcagctattatccggaaagttttagattttccaagggtgttaatgaaagtgtaagtatgatagcagaccaaaaagtatatctttctgcctgggtagaagaaggctgggacgatgaaaatgattgtgaaaccgaagaatataactattatgaaaaagtagtagagagagactttaaagggaatttgttatcagagacgcttggttctttacagcaacacgcagatggaacatggtggatagcataagaattggctcatagaaatatccctgataaaaattaaaattagcgacaataataaaagttaaaaggttagaaaaggaataattaaacaagataattttatcaattttataaataatatctttaacaagccaagtacagaaattcactacttttaggtggaggggagttggcagcagtagaaggaggagcaaaatttatgtgtacagcagcaacatacaaaacacaggatttttattttggcagaacattagattatgaattctcatatggggatgagataaccgtaacaccgcgaaaatatccatttcatttcagacatatgggcgaagtagtatctcattatgcaatgatcggtatggcacatgtagccggagattatccattatattatgacgcagtaaacgaaaaaggccttgcaatggcagggcttaactttgtagggaatgcagtctatcaggaagtagaagaaggcagagaaaatgttgcacagtttgaattcattccatggattttaagcaagtgtgccactgtaaaagaagccagagaatctttaaacaaaatgaatcttgtaggtaccccttttagtgaacaacttccatctgcacagcttcactggatcattgctgatgaaaatgaggcaatcactgtagaatgcatgaaagacggaatgcatatttatgacaatccagtaggcgtccttaccaataaccctccatttgaacagcaaatgttccagttaaataattatatagggctttctccaaaacagccagagaatcgcttctccgataaactaaacttcaatgcatacagcagaggaatgggagcactaggacttccaggggatttatcatctacatcccgatttgtaagagtcgcattcacaaaaatgaattctttttccggtgtatctgaaaaagcgagcatcagccagtttttccatattcttggatcagtagatcagcagagaggctgctgtgaagttgccgatggaaagttcgaaattacactctacacatcttgttgcaatacgaataagggaatttattattatacaacctatgaaaatcatcagatatcagcggtagatatgtttggggagaatctcaatgaaaaagaattgataaaatatccgcttattaaaggagagcagatttactggcagaattagaagtgaattttgagttgccgtaggcaaggggacgcctcggaagagaaccgatagcctatatatgtggcctcggagcaaggtttggatgcgagcgcataagcgaacattcaaactgccgcgactagagtcacatatgtggggtatatcctctttttgagggcgtctttcttgcctgcggcaaatcaaagtttattccggaacgaattcagctgtctggtcgagcatatttatcttcacttttccctttttgccatcaactttagcgaatggaatcacctcatattttgctttctccatgcacttaccagggtcatctgccggttcttcgttgagaaagattttttcagctccgccacttaactggcgtttaatattttttaccatgagacggtcataacgctcacaggctttttctgcttttttctggttttcaggatctgagaaatattcttttgtccattcttctaagtttgcaatttcaatcatcttgtacacttctcctttgatttttatgtctgattatcttttattataagataaattttaaagacaatataggaataataccatttatttatagaaatattacagattctattgtgaatcatggaaagacaaaaaatcagtgtcacatttccctattttatgaaaggattgtccaagagtgaatggaactggtttgctataatgagaataattattgatattgtagaaaactgtgatggaatgtttttttaacatactctggagcaggagtactgcgaattgggataattacgatgaataggaaaacttattaggaaaatttcattaaaaaactcattgtagatggcagtatttacaggaatgttttttcaaacacgctctagcgtgaagtagctgtggtgagttgtgatgaaagaatgaaaggaaaatcaggaggaggttatgtaatggcagacaaaatttgcagtagtgcggacaaggtgctggaggtatttcttgagaatgcaccgatggatacttcccatcatcggatggtgaaacagcagaacaaatgtggttatggattacagggagtatgttgtagattgtgctctaatggtccatgccgactgtctccgtcaaaaccaaaaggagtgtgtggagcagatgcggatacgattgcgtgcagaaatttcttaagacaggtggctgctggctcaggatgttacacgcatgttgttgaaaataccgcaagaagattaaaagagttggcgcaggaattacaggcagaaggcaagaaaccaaaatataaggactctgttgcgaaacttgcaaagattttacagatcaactgttgtggtaactgtgggccggactgccataacagttgtgcgaaaacagcagagatgattgcagatgcagttcttgcagacatcagaaagccatatgatgagaagatgacactcatgaaaaatattgctcttccaaagcgttatgaactgtgggagaaacttggaattttaccaggcggagcaaaagacgagatttttaatgcggttgtaaagacatcgacaaacttgaattcagatccgatggacatgttgttacagtgcttacgtttaggtatttccacaggtaattacggactgattcttacaaatctcatgaacgatattattatgggaccaccacagattagtatggatccggttggtttccgtatcattgatccagagtatattaatattatgattacaggacatcagcagtccatgtttgcagatttggaagaaaaattagaatcagaaattgtacaaaagtctgccgagcttgtcggtgcaaagggaatccgtattgtaggctgtacttgtgtggggcaggattatcaggctcgttctggctgctataaagatgtatactgtggacatgcaggtaataactatacaagtgaagcggtattaatgactggatgtgtggatttggttgtttccgaatttaactgtacgattccgggaatcgagccaatctgtgaacagttagatattaagatgctttgtcttgatgatgtggcaaaaaaggcaaatgcagaattattaccatacacagcagaagaaaaagaaaagattacaagtcagattatcgcagatgctctatgtggatttaagaacagaaaagaaaaattatatggaaccgctccggcagaaggagaaaagcgtgtcaatgtcatggcacagcatggttttgacaaatccattaccggtttatcagaagatactttagtagctgctttaggtggaactttacagccgcttattgatgcgattgttgcaggaaagattaaaggaattgctgcaattgttggatgttctaacttaagagcaaaagggcatgatgtatttaccgtagagcttgcaaaagaattaattaagaaagatattcttgtattatccgccggctgtacctgtggtggattagaaaactgcggacttatgacaatggaagccgtagagctttgtggagaaggattgaaagaaatatgtacagcacttggtgttccaccagtacttaactttggtccatgtcttgcgattggacgaattgagatggctgcctgtgcattagcaaaagaactgaatgtggatctgccacagcttccggttgttattagtgcaccgcagtggcttgaggaacaggcgttggcagatggagcatatgcacttgcacttggcttccctctgcatctggcattatcaccatttgtaacaggaagtcaggtagcagtgaatgttctcacagaagggttaaaggatttaaccggaggccagcttatcattgagacggaagttgaagatgcggcacagaaatttgaggaaattatcaaagaaaaaagaatcggtcttggaattgataaagggggagatgccgtatgttaatgaaccgaacaactccttttatggttccggtagatgagggaaatcctgcgattatcaaggatgaagcgttgtgtagccagtgcgggcattgctttgctatttgcgaagaagaaatcggtgtggcggcaaagtatcttttgaatcctcgcgaaacctatcaatgtatcggctgtggacagtgcagcgcaaactgtccggaaaaagcgattattggcaagccgcattataagattgtaaaagaacttatcaaagatccagataaaatcgttgttttttctacatccccatccgtaagagttggatttgcagacggatttggaaaagaaccgggaacctttgcacaggatgaaatggttggtgcattgagagcattaggtgcggattatgtatttgatgttactttttctgctgaccttacgattatggaagaaggctcagaattactgtcccgtattttaaaaggaacaggaccacttccacagtttacaagctgctgcccagcatgggtaaaatatatggagaacttccatccagataaaacggcacatctttcttctgcaaaaagtccgattggaatgcagggggcagtgattaagacttattttgcacataaaaaacacattgacccggaaaagattatttctgtggcagtcaccccttgtactgctaaaaaggcagaaatcgcaagagaggaattatgtgatgcaggaaagcttcttaatatagaagaaatgcgtgacaatgattatgtgattacgacaaaagaactggtacagtggtgtcaggaggaaggacttgatttagataagattactccttctaagtttgacagtgtcttaggagaaggaaccggggccggaatgattttcggaaataccggcggtgttatggaagcggcacttcgaaccgtttacagagtattagaaggaaaagaagctccggcagatttttatcagcttcgtccagtaagaggattaagcaatcgaaaagaagcagaagtaacaatcgctggaaagaaacttcgggtttgtattctttatggaacggctgcagcggaagaattccttgcagaggatatgaatggttatcattttgtagaagtgatgacctgtccgggaggctgtatcagtggagcgggacagccggattgcggaagtgttccagtatccgatgtcgtaagaaagaagagaatacagtcgctttatcaggcggatgagcaggcagaacgcagaaactccatggataatccggaaattggaacaatatatcacgaatttttcaaagagccattaagcatgctttcagaaaaacttttacatactacttataaaagaaaataagataaagaatgtgcggaatagttcaaaaatgagaattagatattacaactaaaaaaacaatgcaaaatgagaattttttgccgatattttattggcaatgataccaatttgtttcatatcgaaggatgtaattcgttgctgttgcaataaaatgtagcagcaacgtttctttttgttgtgcaaactgtataaatgtaaaaaatatccgattgataattgccacatactgacacggatattactaattgttgcttattttttcctgtataatgcaagacagatgaaagctcagtagtggttgatttacaggatttataggataattttttgagttatcatctctcaaacattttcattgcacatttttatgtgtcagtaagaaggaggaaaattgtaatgattgcaaaaggatttacagaaccaaccgcacgtatcaaagccttaaaagcagaagttgttaacgcagtaccagaagtagagccatatagagccgtacttattacagagtcttacaaagagacagagggtatgccagcagttatgagaagagcaaaagctaacgagaagatttttaacaatcttccagttgtaattcgtgacaacgaattaatcgtaggtgctctttccgtaaaacctcgttctacaaacctttgtccagagttctcatttgactgggtagaaaaagagttcaagacaatggcaactcgtatgtgtgacccattcgtaattactgaagaaacagcagatatccttcacgaagtattcaaatactggaagggtaaaactaccagcgaattagctacttcctacatgagccaggattgtcttgactgccaggctggtggagtatttacagttggtaactactacttcggtggtatcggacacgtgtgtgttgattacggtaaagtattaaaaatcggtttcaagggcgttattgcagaagttgttgaagcaatgaacaaacttgatgcaaatgatccggaatatctgcagaagagagcattctatgaagcagttattatttcttacaatgcagctattaactttgctaagagatacagcaaaaaagcagcagagatggcagctacatgtacagatccagtaagaaaagctgaattacttcagatttccaagaactgtgaccgtgttccagaaaacggagctacaaacttctatgaagcttgtcagtctttctggtttgtacaggcattagtacagattgaagctaacggacattccatttctccaggacgttttgaccagtatatgtggccatacttagaagcagacaagagcatttctaaagaattcgctcaggaattactcgactgcctcttcgtattattaaaccatgtaaacaaaactcgtgatgatgtatctgatcaggcatttgcaggatacgcagtattccagaactttggtgttggtggacagacagaagatggccttgatgctacaaacccagtttcttatatgtgtatggatgcagcagctcacgttagattacctgcaccatcattctccgttcgtattcataaccagacaccggatgagttcttattaagagcttgtgagcttgcaagacttggtactggtgttccagctatgtacaatgatgaagcaatcattcccgcattatgtaacagaggattaactcttgcagatgctcgtaattactgtatcatcggttgtgtagaacctcagtgtccacacaagacagacggatggcatgacgcagcattctttaacgttgctaaggtatttgatatcgctattcatggtggtaagaaccgtgatggcaaacagttaggacctgttacaaaacctatgccagaatggaaatccatggatgatttatatgaagcatatgaaactcagattgagtacttcgtatctaaattagttgaggcagataacgctgttgatatcgctcataaagaaagagcaccattaccatttatgtccgcattagttgatgactgtatcggaagaggtaaaacagttatggaaggtggagctatctacaacttcacaggacctcaggcatttggtaacgtagatacaggtgatgctatctattgtatcaagaaacatgtatttgaagacaaagacttaacaatgcagcagatttacgatgctatggaacacaacttcggtgctgagcttggtgctggatgttacgatggaccattcgtaagattaagtacagattctgcagaacctgcagcagcagctatggaaagtgtttccgtatcttctgaagatagcatggaatctatcatcaacgcagttgttcagaagattcttgcagaaaaaggatctaacttaagtatgagcgtagatacaaaatctgaagcttgcacaagctgcagcgatgctcagagagctgaatacgacagaatcagacatatcctcgacgcaacaccttgcttcggtaacgatattgatgaagttgatatgtgtgctcgtaaagctacacaggtttactctcacgaagttgagaaatacaaaaacccacgtggaggccagtatcaggcaggatgttacccagtatctgctaatgtattatttggtaaagacgtacaggctcttccagatggacgttatagcaacgcacctcttgcagatggtgtttcccctcgtcagggtcatgacgttaagggacctacagctgcaggtaactccgtagctaaacttgaccagttaaatatctctaatggtacattatacaaccagaaattcttaccttctgcagtagcaggtgatcagggacttctgaacttcgcagcagttgttcgtaactacttcgataagaagggtatgcatgtacagttcaacgtaattgatagagaaacattacttgatgctcaggcacatccagaaaactacaaagacttagtagtacgtgtagctggttactccgctcactggacagtacttgctaaggaagtacaggatgatatcattgctcgtacagaacagcatttctaaaatagtagatttttgaaataaactggaggaagtacctatgagtaatatggaaccaagctgcgatacaagtaaaaaagggcttgtctttaatatacagagattctctgtaaatgacggtccgggtgtaagaacgattgcctttttaaatggctgtcctcttcgctgcaaatggtgctgtaaccctgaatcgcaggaattaaaaccagtcgtcatgtttaaagcacaaaactgtgtcggctgtggaaattgtgaggttgtgtgtccaactggtgcttctaatttaaacgttccaggaaaaattgatcatacaaaatgtattgcatgcggaaaatgtattgatgtctgctatcatagggctcttgagatgtccggtaagtggatgacagtagaggaactgatgggagaactttacaaagaccgtgttatttacagaaagtccggaggcggtattaccgtctccggaggtgaagcaatggtacagcacgaatttcttttagagctgttaaaggcttgtaagtcattcggctggaccactgcgattgaaacaactggtatggcttctgaggaagtaatcaaagagattgttccgtggcttgatgtggtcatgatggatattaagcatattgacccagaagtacataaagagtatactggtgtaagtaacgagcaaatacttaaaaatgcattactgatttctagtcttgcaaagaagatgatcattcgtgttccggttattccaggatttaatgcaagtccgaatgtaattgcggcaattgcaaagtttacaacctatctgcataatgtaaatgagttacatcttttaccttatcatgatcttggaagtaacaagtatggaatgctcggcaaggaatatgaacttgccgatgtacagaagccggaaaatgaattcatggaagaattaaaagcaatagtagaaaaagaaggattaacctgtaaaatcggaggataaatcgatacaggcagtccgcggtatcccttatatataccaaaatggtacaggaggttcacaatgaacaaagacataacattattaacttctgaatctgttacagagggacatccggataaagtatgcgatatgatttccgacgctttactggatgcttatttagaggaagacccatctgcccatgtggcattggaaacaatggcttcagaagacacggttttcattgctggtgaagttgcttctttcgcaaaggttgatgttaaaaataaggcaagagaagtcatctgtgaaataggatatgacagtaaagaaaaaggaatagatggaaaagaatgtctaattattaccaatattggtgtacagtcacctgatatcgctcagggagttacacagtgtaacggaactattggagcgggagatcagggaatgatgtatggatatgcttgtgatgatacagaggaacttatgccactgtcgatttcactggcacataaacttagtaaacgacttacacaggtaagaaaagaaggaatccttccatacctctatccagatggaaagtcacaggttacagtagcatataataatcagggagaaatccttggtgttacagatgttgtaatttctgcacagcataatgcagaagtttctgtacaaaagcttcgaatggatattgaggagcatgttataagagaagtaattcctaaagaattgcttttaccggatgtaaagatacatatcaatcctacaggacgattcgtagttggtggtcctgccggagatgtaggtcttaccggaagaaagattattgtagatacttatggtggaattgccagacatggaggcggagcattctcaggaaaagacccgacaaaggttgaccgttccgcagcgtacatggcaagatatgccgcaaagaatgtggttgctgccggattttgtaagaagtgcgagattaatcttgcctatgcaatcggtatcccacagccagtatctataaagatagatacctttggtacagaagaaataccaaaggaaattattgaagacactgtaaatgaagtatttgatttcagcgtggcaggtattataaacagcctatctctcactaaggtgaaatataaaccagtcgcagcctacggacactttggaagaacagatcttgatctcccgtgggaacggttagataaagtgaatattcttcaggaaaaagcagttgcccgtgtggcagaagaaatctacaaaaaccgttaacaaatattaaatacaacaatcattacactttttaataattatagaaactattcaaagtcagatggtttcagcgactgagactttagaatagtgaaatagctaaggggtcattcaagcgcataattgttctgaaataatcggtctcaacactctcacaaatagattatgaaataacaataagcttgatccacataaagggggctgtcgcaaggtgacagtcccctgatttaatttttggaacaacagacggtagtaagaacatagatgattaaatcaggggatttctatgcgagccgctttgaagaagaaatattcatcttgcataaatggtaattaatagttaaaatataattatatgatagaagtaagtaaccatacaggtaaaagcattatgatgtggatgcaggcttgcaaagtggttgtgaatattactattataattttagaaggaggatttttaaaatggtaagaaaagcaaatatcattcagaaacaggaacttggcggtggaaaaggttgtgcagaggtgcatgagattgttccagagaaagatttatatggacatggaaagttatatgcaaaggttgttttaaaaccgaattccagtgttggctggcatcgtcatgttggtgaaacagaaccatattatatcttagagggtgagggaattttcgtagatgatgatggaagccgtacaaaggtaggtcctggagatgtatgtacaattcttccgggacagtgccatgcgattgagaatgcatcatcatgtaaggatcttgcatttatggctttgattcataaagactgattcgcttgattttttattaagggagacgaacccccgaagagaaccctaccctatatttgtgactctatcgctgcgggttgaatgttcgcttaatggctcacattcaatcctcgctctaaggccacaaatatagggtagggttctcttcgggggttctgttttttgataaaacaaataagtaagaggggtctttggtgatagtagatataaatgcatgatgttggggtgggaagggtatctgtaggtttagtttactaaaacagaaatgaaggacttctcatttttcgtctgtctcatattacaagaggggtaattatttgttggattttgctctccttatcacaaataaagaatcaagaaaattacatgtaaatgcaatatattttcctatgattgagaaatagcacaaaaaaaccaatttattttttgtgtaaaaatgataaaatatatactaagtagggtgtagtgtaaaaaaagtaaaattttttgtctttatttttacaagtaaatatccctttggaggtgaacatggaaacggaaaagaaaaatggcagagggaaaaaagaagttagcttgttaggcttatttggtaaaaagtttttggaagaaacacagggtaagctggcagaagcgacaggtatttctttttttattattgattataagggggagccggttacaaagggagaacaagaggaagatttttgtgaaaaaaggaaggaagaagatatacgctgcagtgagtgtcagattacgagagcgtttgcagcagcgaaaagtgcaattaaaaactgtccgtatatttttacttgtccaaatggacttgttcatatggcgattccgattgttgtaaataaccagtatataggggcaattatcgggggaccgataagatgtgagaagaaggctttaaaagatagtgaacttggagatacagaacaggaaagaaaagcttttttagataagcttggggaagaaacagaatatcagaatattacttcatttacagaaaagagagtagtagctgtagcagatatggttttccttctttttaaagagatgggagtaaaagaaacaacggcgattaaacttggagctttagaacataaagaggtgcatctttctgatatccgtaagagaaataagttgttagaagataaagtatcacagcttgagtatgagcttcttaaaggaaagttaccaaagcagtttatgttgaatcttttaacgacggtctctagtttttctattctggagaatgcaagccggacggagaatatcacggccgaaatggcatcggttttgcgttattatctggataattcttcagaagttatttcattatcggaagaattaaagcagatagaatgttatctggatattttaagacagcagtatgataaccgattagagtatcgtgtgtattgtcagaaggaagtggagaagcagaagattccgattattggaattttcccatttgtagaacaactggttgattttggaattcttgcaggccatttcagaggaacattgtatattgatgcagagaaaaaagaagatttctgtaaagtagttttacagttagaaagttctggactatctgttgggcattttggagcagatatcacagacggtaattttgcacagatgcaggaacaagatacaagaaagcgttatgagagagagtttggcaaagactttgagataacggcagatccgaatgttataacgatacaaattccatttcaggaaataaagtaaggagggggctatgataaatattttattgattgaccaggaaccattgtttcagcaggcattttccagaatgattgcggaaacggaagaatgccagcttattggaattgcggagaatagtaaagaagcattcgagattgcaagccgctatcatccacagattgtattttgtgatgttgttcttggcatggagaatggaattgctctctgtaatcttattaaggagcattttcctgagattacgacctatattttatcaaattactgtagtttccagatgattcgtcattccatggatgcaggggtagaggaatatttatataaaccattatcgagaaaaaagctttcagaattaatcgagagaaacaatgcttcaagtctaaatgaagaagaaaatttacagcaggaagcattacttgcagcaattgagcaaaaagattataaaaaagcatatgatacagcgaaggaattagtagagtatttatttgaagagtgtgaacgcagagagcgcaggagcaagctgtctatgttagaatccagtctgttttatatgatacccggaatggataatattcagaaaaattattatttccagaaatatgagattacaatgaaagtattgaccaaaagtgcgatatgctatcactggctcattcaaattataacagaagtgttccgtcagctttgtacaatgaagtatgcacatatgaacaaggtatttcagtacatagaaaataataaaaataacgagatttccctttctgaacttgcagacgaggcaggaatcagcagtggttatctgagtcgtatctttaaaaaatattacaaaatcagtgtcgtagactatatccatcttcgtaaattactacaggcaaaatactacatggcaacaagtgaaatgaatatctcagacatatctttccttcttggctacagcgaagcaggatatttctgcaaaatattcaaaaaatacgaaggacagaccccatcggcattcaacaagaatttccagaaactcacttcgaaggcagggtgatttaacggaagtaattaaagagcggaggccatttcgaaggcacaaaaaaagaaattctataatatcacatctatagcttatatctattccagagcaagcaaagtataacagactataacttcaaatcacccccatggtgaattgggcttaaactaaagcagctaacaaacagaaaccagagagattatattcttatatctgtggcctgggagcaagtgttggatgcgagcgcataagcgagcattcaacacgccgcgactaaagtcacagatataagaatataatctctctggtttcgtctgtccgtctgttcgttctaaagcccaatacaccaaaaatccttttggaagagatcatcgccgcttttgtctctgaaagcaggatgaaagtcaaagtggactgcaccgacaggaatctgtcgatcaacagccttgctgattcgggcaacaccctcatttccgaaagcaccacataaatcaatagcagcacatccttcttcaagcatttcctgtgctacagtttctgcctggctgtaatcagcacatccgacaacgtacatgatgattttttcggattcaatgatggaacggtcctttttcgggttacagccctcatttgcaaaaatgaaagcaactttaaatttgtcttcgtttaatttgaattttcttgccattttaccaacgccttatctaagatttccattgcttttttaccgtcattagcagtaataagctggatattatgtttgcggattgtctggtatgtttccatgagaagatcgatatctgttgtgattttgtcgagtgtgattacgacaataacgtcaaggttgtcttcctcaatatctttcattaatcttctgaagccgggacgttcaagattctcggatgggtagtctcctaaatctgtataattaacaaattcgttatcttcgccataaataccttttgcacgattcatacacttcataccatcggcaatcatcccctgtacataggtctgtgtacagatgggacagccaccccggagatgctgatgattataaattccaatacgcatattaattccctccagtacattttcttaaatatagattcttatatctattgtagcagaagggcgaaggaggatagggaagatacgggaacaattatgggaaataacgaaagtcagaaaaagaatagaaaaagaaataaggagtatcgttatatttccatagataaagcatgataatcctataaaaaatagtataaaaatgctaaaatgatactgaaatagtctgtaaaggaggagaataatggaacgacgagaacttgaacggcagattgtcgaaaaggaatggctcatgtttcagcaggtacagggcgtaaatggacgggcagcctgccaggatgactggacaacttttcttattatgcgtctcagtcagtttgaaggctgggataccgatgtgcttgaaagctattttgaagacattgtccaggcagaagcacaggagagaaatctcattatggagaaatatgcctatatgatggaggaaacagacccggtatatttcttatcaattaaggaattgcttccagagatttcggaagaaaaacagttgatggctgaaaaaatcacttctatttatatggagtgggaaaaggaagcggatatcaaatatccgaatatccgaagacatggaagaccggcagaaggaattggggtagatggaacggtcagtgtaagaaattatttaaagtgtgaactttatacttattctgcaaagacactggcactttttattctgtctattgagaaaaatccagaatacaaccgttatcttgctacaatgcagaagatggtacaggcatatggctattcttctttagaagaagcggaaaaagaaatggcataaattttagttaagtgtactgacacagggacattgtgacggttgtttcagttaaatatattgagatatcgatattgtgatgatttatgtcagttcgcgagtacataagaaaggagaattaacatgcagaaaatattattactggctggggattttacagaagattatgagacaatggtgccatttcaggcattgtccatgcttggatatcaggtagatgccgtctgtccgggaaagaaggcaggcgaatttatcaagacagccattcacgactttgaaggtgaccaaacttacacggaaaaaccagggcatctttttaaattaacaaaaacatttgatgaagtagattttgatgactatatcggactttttattactggcggacgttctccagaatatatccgaatggatcacaaagtaatttctctggtaaaatgtttcgtaagaagtggaaaaccagtagcagctatctgccatgcagcacaggttcttactgcagcagatgttgtatgcggaagaaagcttacctgctatcctgcattagcagcagaggtaaaattagcaggaggtaattatattgaagttgcaccggatgaagcggttgtagactgcaatctgatcacttcaccagcatggccaggaaatacagcaattttaagagaatttgcaaaagcattaggatgtgaatttattttcagaccataaatgtatctgggctatgtaagttacaaaaattagtgtattgtttcattgatattttatttgatcttgcaggagaaagaaatttaggcaagaattaaatatgattaaaaaagaataggaggaacagtaatgggttctcttttagaagaaatgcataagatgcgtttaaaagaaaaaatagacgaattagagagtatgggtggaaatccacatgtagcggatcacggacttggcggagtgtatcgctgtaaagtctgtggatatattttcgatgaaaataaagaagggagaccatttacaacattgtcccattgcccaatctgtcatgtagggcagcagcagtttgaaaagatagagtgaatgcctatgaaaatggagcgttttaacgaaattttaaataagctgatgcagatggaagatgctgaagagaatctggaaatggttcctctttatgaggaggcattggagctttcaaaagagatttacggagaatataatttgaagacactggaaatttataataattatggtggacatctccgcaatcttggattgtatgagaaggcggaacagattttaagaaaggcagttatttgtgcaagaacagtgcggggtaaagaacatcctgactatgcaacaacgcttgtgaatcttgccaatctgcttcgcatgatgaagcagtgggaggagagcgagacacttttttatcaggcattggctctttacaaaattacaatcggagaaagtcattttatttatgcggggacaatgaataatctgggacttctctattatgagcagggaaagcttgaacgggcaaaagagtgtttagaacacagcctgcatatattagaaggtaaggcagagtatattattccgtatgcgacaacactccataatcttgtagatatctataaaaaagagggcaatcttactttagcagaagaaactctcaaaaaagaaatagagatttacaaagaacagcagtatgagggaacggttctttatgccgcagctttaaattctcttggaatcctttactgtgaaaaagggcagtatgagaaagcaaaagctgtgatgaccgagagcgtagatattacgaaaaagcatcttggagagtcaagtgatgcctataagacaagtgtaaagaatcttgagatgattcaggaaaagctgcaggagcataaaattaagagtaatcatgagattttgcaggaaactttaaaagaaatgacaacagcttcctgtgcccaggaatataatctggaaactgcaatggcgagtgccagaaaggtattagaaaacagccccaaagttgtagagacaggttttgtcaaagggcttgatttatgcagagcatattttaacgaagtatgctatcctcttttggaaagagagtttgccaacttccttcctcgtatggcagccggcctcatcggagaaggctccgagtgttatggttttgatgatgagatttcaagagatcatgactttggaccatcttttcagatttatattcctaaagaagatatgcctgtttacggagagaggttaaagcatagacttgcgacattgcctaaaacatttcagggctttggtgcgagagtggaaagccagtatggcgatggcagagttggtgtatttaccatcgaagatttttatcggaagtttactgcggcagagggagtaccagacactctttctcattggaggcagattccggagaatgccctttctaccgtaacaaacggagaagttttctttgataattatggagaatttacaagaatccgtgaggaattaaagaaaggctatccagaagatgtcagattgaaaaagattgccgcccgtcttatgaaaatggcacagagtggccagtataacttccctcgctgtaacaaacggaaagaatatgtagcttcccgtctggcattaagcgagtttatgtccgtttctatgtcattagtctatctgctcaatcatgcttaccggccatattataaatgggtacacagaggacttttagatttaccaatcttagggcagaatgcttatgacaaaatgcagaggctatctgttttatctttagaaaaagatagcagggaaatggaatggattattgaagaattttgtgttgcctgtgtggaagaattaaaagcacagggactgacctcatcctcagaagcatttttacttgcacagggaccggaagtattaaaaagaatacaggaaccagctttaagaaatagtaacccgtgggtggaataactgttgacagcgttttggtaaaacacgtagtacagtgatgttgaatagccctttttctttcttatcatatactgataaaaaaagaaagctgcggctatggaaatgaccaatgtaggtaatttgttagagctaagaaggatttacagccgtggtattaccggaaaaggtattactacggctgttttggatacaggaatttatgcacatcctgacttttttattccacagaataaaattctttattttcaggattttgtgagaaatagaagaggtccctttgatgataatgggcatgggacccatgtcagtggaattatcgcatcaggaggacggtttggagatgggagtggaatcggggttgcgccggaaagcagtattgtaatgctcaaagtacttgaacgggatggaagcgggaaaataaaaaatatgataaaaggtatggaatggatttgtctgaatcataaaaaatatggaatccgaattgtaaatatttctgttggaatgcccgtaaaaaatatagaaaatcctgacgaagatattcttgtaaaaaaggtggaggagttgtggaacgccggacttgttgtcgtagtggcagcaggaaatgacgggccggcaccacatacgattacaagcccgggaacaagccggaaagttattactgttggaaccggaacagaagcaggcggagaatattctgggcagggtcctgtacttggaagctgtgtctgtaagcctgacatcattgcgccagctaccaatattttaagctgcgataatcatggaaaaagttacaaaaaaagaagcggcacatcaatggcaaccccgattgtatcagggacaatagccttgcttctttccaatgaaccgtggctgtcaaacagagatgtaaaaatacgtctgatgcagaacgcggttgactgtgggatggcaaaaagcagacagggatggggcctgctaaatcccgaaggaatgttgaggattaaataggaatttgccgcaggcaagggagacgcccccgaagagagtctctttaccagatgggttcgtctgtcctgtgtccgtaggacaaaaaaatatcatgttttttgttgccttcataagaaatgcaccaaaaagtacggctgaatttcacaaaaaagataaataaaaacggaaatttacaggcaaaattcataaaaaaatctttttcgtttactggtgcgctgttataataataacagaaataaagagtaataaacacgttcagtaaaggagaagggtatcatggcaaactgtattacacttaatcagacatcttatcacggagcaggagcaatccagtctattccagatgaagtaaaggcacacggacttaacaaagcatttgtatgttctgaccctgacttgattaagtttggagtaacaaagaaagtaacagacgtattagacgctgcaaaattagaatatgagatttattccaatatcaaaccaaacccaacaatcgaaaacgtacagactggtgtagctgcatttaaagcatctggagcagattattttatcgcaatcggcggtggttcttctatggatacagcaaaagccattggtgttatcattaacaaccctgactttgaggatgtaagaagcttagagggagtagctcctacaacaaaaccaactgtacctatcattgccgtacctacaacagcaggaacagcagcagaggtaacaatcaactacgttatcaaagatgatgaaaaacagcgtaaatttgtttgtgtagaccctaaagatattccagtagtagctatcgttgaccctgatatgatgagcagtatgccatatggtcttacagcatcaacaggtatggatgctctgacacatgctatcgaaggatacatcacaaaagctgcatgggaaatgacagacatgttccatatcaaagctatcgaagttatcgcaagaagccttcgtgctgcatgtgaaaatgatcctaagggaagagaagacatggcacttggacagtacattgctggtatgggattctctaatgtaggtcttggtatcgttcattctatggctcacgcattaggtgctgtatacgatacacctcatggtgttgctaatgcgatccttcttcctactgttatggcatataatgcagatgcaacaggaacaaaatacaaagacatcgctatcgctatgggagttgaaggcgtagaagatatgactcaggaagaatacagaaaagcagcagtggatgcagtagcacagctttctaaggatgttaagattcctcaggacttaaaagacatcgtaaaagaagaagacttagacttcctcgtagattctgcatataatgatgcatgtgctcctggaaatccaaaggatgcaacaaaagaagacattaaagctttatatcagtcattaatgtaatcggattttatataactacgtcaagttatcaatattataataaagggaaccggaaaacagcgttgctgttttccggttctttttcaactaactccagacaacttctggtttgtcaggctgcggagcagacgaactcctgaagctaaataaagcatatttgtgactttagtcgcggcggtttgaatgttcgcttaaagcgctcacatccaaaccttgctccgaggccacaaatatgctttatttagcttcaggagttctgtgcgttgacagctcagaaaaccagttggaggaatttggggattcctcgaaagactgtgattttatgagaaaatataatgaattcataacagtatgttaaaaagataatatttaaattcgatttttcaaagtttttatagcggatgtttatgtttactcctgcatcaacaaatcagtgaaaaaatttgagaaagtgaatcagagtaatatctttttataccatgttatagagaagttgattttttacaaattcataatattctggagaatcctcaaatcctctaagatgaattctgactttcctccaactgccaatgcacagccttcgaagaaagcttattctctatatttgtggcctcggagcaagtgttggatacgagcgagtagagcgagtattcaacacgccgcgactaaagtcacaaatatagggaataagctttcttcgaaggcgtctactttgctgcgcaaatcagaatctgtctttttttgcgctcgttttccggtataaacttcccatatttgcatatttagtattatggcaactatttagcagtcctttttgtgaagaataaaggatattttaggagaaaaagaaagtagggagagtgcaatatgtggaaaaaagtaaagcgaatcctatcatgcatccttgcactaatattgctgttatcgttgatagatggacagcagttttttgtacgggcagagagtgaagtaaaggtaacacagacagaacaagcgtcaaataagatggaggaaacaaaaacttcttctagaaaggaagaagggtcggaagcaaacaataaggagaatggcaaacaagaagaaggaacacaaaaggaagaactatctacaaaggcaacagaaaaaacaacggaaacgaaaaatgaagatggaaaggtggacaaaccagacaacttaaataaagagaatgaaaataatggacaggaaaatggtggaaagaatgaagaaaaagagacaggggataagggagaggagacaataaaggaaaaagcggaagaagcttctgccgaggaagatactgcacaggagacagaggccaaagaacaaatagatgctacggatgacacacaagagcggatgaatcagcaggacgaaaatgtgccagcaatggcgcagagggggacagacgtatctgaaaaagagacagagtatgttccaaagagtcagccccagggggtaagtataaaggtatatgcaaaagaaaatgttttcccagaagggacgacgatgaaggtaaaggagttaaccaataaggaattagatagtgcacaaaatgttctggaaaaaggtaatgtatcttacgatggttttcttggctatgatatcagtttttataataaagaaggaaaagaaattgaaccggaagaaggaagcgtaagagtggaagtggatatgaatctgaatctgctcccaaaagatctgcagatggatacgttgcagatgcagcatttgaaagaggaaaagaaagacaggactgttgagacagtggcaaaagcagcagatcataagttatctgtaagtaaaagtaaggtaacagcaaagtttgaagtaaagagtttttctgattttattttgacatggaatattgatgcgacaccggctgacccattagaaacaggagataatgcggcatccatagaaaaacagataaatcatgaaaaatatgcgacattaagggatgatggaacttatgacttgacccttaccgttgcagggaaaaagggaacggagacaaataaagccaagcttgatgtaatatatattcttgataaatcaggaagtatgaaagaagattttggtggaacatcaaaacggattgcggcatctaacgcaattaccgcgcttacgaaaagtttgaagcaaaatgcgaatattgatgctcgtttttctatggttacatttagtggaaataaaacaacaggaatgtgggggcaaggagataccaagacctgggatgatgcagaagtagcggtaagttggactactgatgcaggaacgattgagagaggctccaaaccaacttcaaatggtggaacaaattatcaggcaggtattcggactgcgaaagaattgctgaccagtaagagagcaggggcaatgacagcggttatttttatctctgacggtgatccgactttctattataatccagacggatatactaggggagatggcaataacgatggcaatggcggagcagataatttaaaggtatgcctggatgcggcaaaaaatgaaatcgcaaatcttggcgtaaattatttctatacagttggtgtaggaaaagcgaatgattatgtgaatttaagtgacttatgtagcgcatctggtgtgagtggcgcgaaaaactttgatggcacaaatacagatgagttaacgaaagcatttagcaccattgagtcagatattttaacctttttatgttcgaatgtttctattcaggatgtactgagtgagaatgtagagattgtaaaagacaaagatggtgtatttaaaagtctgaaaattgtagtgactggtaaagagggaaaaactatagtggaaggtgacaataaagttacatttcaagatggaacacaaaatgtcacattaaaagcaggatatgacagcaaaacaaagactattaccttagattttccagcggaatatcagttaaatgcagagtatacatataaagtaattgcgaatattgatgcgacagaaaaagcttatgaaaattatcgaaagaatttgactgacaataaagatgagaatgaaaagggatataaggatgttgcagatgccggaacaggaacccatgcagggaaaaaaggtatgtatacgaacgagaacagtgaggcgaaaatgacctatactttccgtggagaagagtatacagaattatatgacaaaccggttatcaaacttcattcaggtaagttgattttagaaaaagaagtggaaggacttgacagtcttacaccagaacagcttgaacaatataaagcaaatttgaaatttaaaatcaaagtaaagacaaagaataataccagcttaaaagaggaagaaataacactgactgatcttgcaaaagaaagtaatggaaatgaagatagtggaaatagtagtaataccaataaaagaaataagtacatttatactgttatggaaggaattaatccgggaagtttctacgaaatcacggaagatggtggtgaagtagaagggtatatctgggagactgcagcggacaaaaaaagtgagaatggaacaatagcaaaagatgagacagaaaaggtttcctttaagaatacatatagcagaaagaagattcctttaattataaataaaacagtcgaaggaaatatgtcagaaaaaagaaaagagtttgcattttccattacattaaaagatgcgaatggagctgtctatgaattatctgatgaggagataaaagacgtaggagttagcacaaagggagagggccaaaaaggagtatatacatttacgttaaaagatggagaaagtaaagaattctctcttccatacggatgtaaatatactatttcagaagaggattattcctcatcaggatataaaacatatattggagaaaaaaaggaagaaaatcaaaagagaacgacagaagaagaaacacttactcagaaaatagaaataaatttccttaataaaaaagaggttatcccaccaacgggtgttgaaacaacgatgacagcatggcttcttatgacaggagtaactcttttattaggagcggtatttctgctgtttggaattcgcagaaagagattcgtcgcatgagtgaaataaaagcattttttatccgtcttgtaattttacttatttttctatggctgttgtttggtgtattctttggaattacaccaatgcgtggaaatgacatgttcccccgcattagtgccggagatctcctgctttactatcgattggagaaaaattttaacagtggagatgtcctcgtatttagaaaacaggggaaaataagtactggaagagtcgtggcacatggcggcgattccgtagaaattacaggggatggcgaattaaaagtaaatggaagcatagtaatagaaacgaatgtattttataaaacctatccatatgacaaaaagaaagtgaactatcctctttcgctaaagaaagacgaagtatttcttctgtgcgactacagggagggggaagagacagccgctattttggggcggtttctaaaaaagaaatcaaaggaaaagtcatcacgattttaagacgttctgatttatagaatctataaaaaacagtagagaatataaagaaatatacaaatgccgaaaaaagaaaggtatctcgtgcttttggaaaaagcaattttccccgctaaaatccaaaagcacttgatatagcggaaggcagatgtcttccgctgatagatagttagctgacagtaaatgatcttaacgaagaaagagaggcaatttgttatgagagcggacaaaaagaaattttcgacacggttgatggcggcgctgatggcaggaacattggcggcaggaatgatggggatgaatgtgagcgcggccgttgttcacagtggaaatccgattacaacgattcctgtaactaaaaatgtattgacagatggaaatacgatggcaccaaatactacatttgagtttgaggttgctgttgctgatgcaggaacatttaatgatgggaataaagatcaggtagtttataagggtatagctggaggattaacagcagaaacaggagcagcctttacgccgggaggaaaaggaagtgcagcagaaacttatacagcagaaggatctttaaaaacagatgctgctgtatttgaaagaccgggcgtttatcattatacagtaacagagaaggcaaataattatgaaggtgtaacaacagatacaacttcctacgatgtatatgtatatgtgtataatagaacagatggactttatgtgggaaatgttgtttcagctaaaaatggcgataaggcagatctgatttttaacaatgattatggtcaggacaaaaacaaagatactacacatgatgtagtgattaaaaaagtaattacaggtaatcaggctgtagaaagtgatacattccagttggttgtaacagtaactggaactgcaggagaaaaatataaagtaacacttgataatgcagagcagaaccctcttacaagtggagaaaaggctacatatacagttacaaataatacagaaattcatatctatggtttaacagaaggcgacaaggttcaagcagtagaggaagcgaatactcagggatatcaagctacttatacaactggtttatcagaaggaacattaacaatttccagtgatggtagtgaggccacagtaacaaatactaaaaattccacaagcccaacaggtgttattctcaactacggtccatacatccttatgattgctcttgcaggttctatggcagcattcttctttttcaaaagaaatcgcaaagaggcataaaaaatccataaacataaagaatgaataaggaggggcagggtacggatgaaaatcgcagttcgtattgcacaggcaggcaatcagattctaaatatcatcgtaatgggaattattttattcttattcttgtatggcgggtattctttatgggatacttatatgagtgcaaagagtgcatttttatccgatgatttgctttcctataaaccacagccgggggagggggcaaatccttccctggaagatttgatggcaattaacaaagatgtggcaggatggattacaatagatgatacccatattgattacccggttgtacagggaaaagatgatatggagtatatcaataaagatgtatatggagaattttctttatcaggttctatttttttatcctgcatgaataaaaaagatttttccgacaattataatctggtatatggacaccacatggcaaatgggggaatgttcggagatgtggtatctttcacggaaaaaagttattttgacaaacataaaacaggagagctgtatttgccagataaaacgatgcatattgatctgtttgcctgtatgaaaacttcagcatccgattctaaagtttataacccacaaaatatatcgaaaacttcggaatcttttaaaagttttcttgactatgtcagggaagctgccatctgttatcgagatagcggaaggcaggatactggacagattattgggttatcgacctgttcggaagcagtaacgaatggaagggtaatactttttggaaggttgagtgaggtaacaaaaagcaatcaaaagcaaaagaaagcagagtaagggaggtgctttcaggacaaatgaaacgaagtaaaataaaaggaaaatggatatggggagtgctttccacaaccctggcaattattttccttttttcggtaaaaatgatagcagtttatgcagcagaaggggagcgggagtgtacaattgcgattccggtttctgtagaaatgaaaggaaatataaagtcagaagtttttgagtacgctttagaacctgccgatgaaaacagttctacagaagcggtatttagcgaagtggaggtgacgcaggaaggaatcacaaaaggcagctttgaggaaatgcgttatacgagacctggagactataaatatacggtatatcaattaaaaggcgagagtaaagatgtcatttatgatggttcagtatatgaagttaccgttcgcgttgtaaatacgcaggagggcggccttgctgcagaagtctgggcagtaaaagaccagtctgatcagaaaactgatgaaataaagtttataaatcagtataaagaaacaacaacggcaacgacagaagccataaataatacgattcatcatactataacgaacacaatcacaaagtcctctataggaacatcttctcccaaaacaggagataaaagtaatgtgatgttatggggtggaattgccattttatcaggtttatgtgtattcttttttatatttgaaggaaaaagaagaaagacagaagaatagaaatatcaaaatagcctttaaatcaaaaatagaaaaacaattaaaaaaatagataactaaaataaactgtaaataaaaacagaaaaataaaaaagtagaaattctgtaagtgttttggacaacagtagtgcgaaacatttgcagaatttttttagtcaatcaaatttaattatctattgaaaaataaaaatttatcagatattattttgcgataaatgcttttgtacttgattttgtgagtacataaatagaaaatgagagaaaaatgaggaacgacatgagaaacatttaccgcaaaaaacagataaacctaatcataatggcagttcttagtttataagaggaatcaatcagaagaagaacggaagctattcttctgtacaaagaattcgcactttatctgatgccaaaccgggacttgcagtttccgtgagtggaacaacgggaatgttaagctggaatgaaagatggaaattatacatatcgcagaccagcgcaagtgacgattaaagcagatggaaaagacgtggagaatggaacattctggattcgtgatgatgcagcatttactacgcatacaattaatgtaaaaggctgcaaggatttaagaatttttattacacagggaaatataattaaaaagtttgatacggaatatggttttgcagatgtaaaacttagcaagtagaataacaagacctggagcgttttgcaatatgcgtcagtgctagagtgtgtttgaaaaatcattcccgtagtctgcaaattgtaatgcacatcttacagaaagtccgataaattccggaaaataaaagtacagtaataaaatatcccttgacatttttcacagaaagtatataatagtgatactacggttcaaagaaccctcatgggggcttgtactggtttcgacggggattttgaacgtggggcagccatccgtggtccgggaccacgttaaaactcggaactaaatataaacgctgaagataatttagcatacgctgcctagttgcagctgtcggccttagtatccccacagactgagagtccggcaccgattatgtgggacactcgtattccaaagctttgcggagtatgaagtaacatgaagctactgaaatctggagtttgtctttagacgccagacagagggaatgtcaaaatagagactgtgatgggagataccgtacggaataggttttcggacaggggttcgattcccctcaggtccataagacgacccttgaaatatggcttatttaagccgtatttcgagggtttctttagttagcatcataaaaacagtttttttattacatattatttgttggagaatgagatatggttgattatcattctttaaagtcatacatttccaaatagcgaaatcttttcatttggattataatacttttcctctttcgtcacttttgacaaactacctcccctattgtagaatagagcagaatgtgaaaaaagagggaagaaggaaaatagcgatgaatgcaaaagtaaaaggaaccgcatttgctctttttggtggagcgtgctggggattatcgagtgtagtgggaaagctcctcttcgatatgagaggaatgaacgcagagtggcttgtcacagcaaggcttgtttttggtggatttatcatgctctgctttgcggcctttcagaaaaaaggtgaaatttttaaaatatggaaagaaaagaaaacggcatttagcatgattttatttgcagcattgggaatgctggcatgtcagcttacatactttttatgtgtgcagtattcgaacccggcgacagcgacagtgcttcagtacacctcgccggttatgattatgctgttatgccttttccttgatagaaaactgccaagaattattgatattatcgtgctgattgcagtagttgtgggggtatttttaatgtctacacatggaaatattcacagccttgcaatttcgcaaaaagctttaattttaggaattacaacagctattaccgttgtattttatacggtttggccagtacgtctgttaagggagtatggctcaacgcttgttattggctggggaatgtttatcggcggaattatgctgatgccattttcaaaattctgggcacctccgggaagatgggactgggttaccataaccttagtggcaattgtagttgtattcggaacgattgtttcttttagctgttatttaaaaggcgtgatgtatttgggaccggtaaagagtagtctgtttgcctgcatggagccgcttgtttctacgattcttacaatatttttattacatcaggcatttgtggcggcagatattgtaggaattgcactgattattgtcagcgttacttctttggcagtgaatgatgttataaaagaggccagggaaaaggaaaaataaaaattttaaagtaagaaaaacttattctatagataaaagtaattttcttaaaaagctcaattatggattaaagatacaaagtaaataagattatatttttgggtatgaagatcaagtacaggaaaaggagctgcaaaaatttttaggtctggatttttccatgcatgaggaggaacagggcaagaaacttgtgaaggtggatagattttttgcaagcagccagacctgttctgtttgtggttacaaaaatgcaaaaatgaaaaatcttgcgttaagagagtgggattgtccgcagtgcgggacccatcatgacagagatgtaaatgcgtatgtgagaaaaaatgcaggattacaaacggcggatatatggtataataaagaagatttcgtaaaagaaattatagagcaacgtaacaagaacccagagcgtgtttaataagttctaaaaattaaggttgtatgctctaatatatcaggcagttataaatgaattgagatatcagaaagcgtatattctgatattttaagccagagatacttatcgaaaggaagaggaaaaatggtaattgtaaaagtaacagaaagtaattttgagcaggaagtattacaggcagagggaaaagttctcgtagatttctgggcagtctggtgtggaccatgccagatgttatctccaatcgtggatgaagtagctgcagaagcgggaaatgtaaaagttggaaaggttaatgtagatgaagaaccagcacttgctgcaaagttcggcgttatgagcattccaacactactcgtatttgagaatggaaaagttgtaaaacagtccattggctatattgaaaaagatgaggttatggctcttattcagtagggcaaagcagagcatatctaagatagaataaataagctgttgtcagagaaaactgatgacagctttttgtcatttgctgcatattttgttatataatgcagcaatctcatgttttttgaggagtaaaaatgaaaaatacaaaagtctatttaatgagtacggaaaatgtaaaagatcccagaacttttgcattgtggaaagaatttcttcctaaagaacattgggagaaaacagtgcgcccactaaaagaagaagatagaaaaacggagcttgctgcatggtttttattatatcaggcactaagagagtgggggatttcagaagaaaaaatcaatgcagacggtgcgtattattatggagaacatggcaaaccgatgcgaagaaatgaagaaatctgttttaatctttctcattctgggaaatatgtactgtgtgcagtatcagaaatggaaattggctgtgatattgaaaagataaaggaagtaaagtggaagcttgcgaaaagatttttttcggaaaaagagtatgattttttggtgaggctggggagacaagaaaaattaatgaaacaaggggaaacagtcaaatctggaaagacagataagcaagagaaagtaggtaaacaacaaaatataaatagacagaaagaaaaaggaaaaatcaaggaaaatgcatatacagttgaagaagcttttactcgtttttgggtattgagagagagctatgtaaaaaaaacaggggaaggacttggagctgctttgactggattggatttctcggatattttaggtcaaaagaattccaaaggaaaaaagaacggagagtttttggaggaaactttttttgaaatggaatatgatggataccggatagcgatttgtggggaaaaagatagtaaaccggaatttgtcgtgtatcgtgggactattgacaattgttttctttaataatataatttttaagataagttattctctgtttttatacagaaaggtaatttaattgaagccaggttaggagtggaaaaatggcagtagaaggaacaaaaatcagagagatgatggaaggaaaaactctcgaaaaagataacataaagaagatgtatgatatggtgcagaatgcatcagaaccagaagataagaaaaaggttatgaaacattctgttttttttattggacagcttcctttaaaagagaatcatattgttgatcttgaacagacgagaagaattgtgaatggtagtgttccattttcagaagtggatacttacatggattatttgctgaaagggctatctacacagaagcttcttttagagaaagaagatggttcctatgaagtgaatacaaaatatgagaagtctgtaatcaaggttcgtaagattgccagagcatttcagcttgagaaggaaaaagcattagaggcaggaattccaaaagcaaaaaagatgtatcagatgggaacaaaatactatcattccggtcagtacgaggaggcagcggcctgctttatgaatgcggcggaattagcagagtaccgcatggcatactatagccttgccttgatgtattttaagggacagggtgtagatcagtcttttgaagaagcactctattatgcaaggaaggcccttgtaaaaggagctgttatcgctcaggaattagagcaggagattttagaagcaatgaatgcttaaaagaaaggatatatttttattatgaaaaagtttgcaacaattgcacttgcagtcgttttgtcaatgggtatcctgacaggatgcggcagtagtaaaaaggcggcagaagcaacaacagaagtaaaggaagaaactgtagattatggacagggacttaatgaagatggaacattagaaggagtaaaagcaacggattatgtgacggtatgtgattattctgctttaaagattcccaaaaaggaagtaaaggtatcagacagtgatgtacagacagagattgataccatcttatccagctataatcaggtaacagatcgtaaagtcaaaaaaggagatacggttaatattgattataaaggaatggttgatggtaaagaatttgatggtggaacagccagcggtgccagcctcaaaattggttcaggaacttttattgatggttttgaagatcagttaattggtaaaatgccaggcgagacggttcaggtaaaagtaacttttccaaaagattatcaggggaaagaggttgccggaaaggatgctgtatttgaaacaacaatcaactatattgatgagacaccaaagcttacagataagtttgtaaaagaaaagttatctgacaggtatggttatacaactgtaaaagagatgaaaaagacaatcagagatgagattttcaagacgaacaaaacagattatatctggaatcatatgattgaaaagagtaaattcaaagaaattccagacgaacttatcaatgacagagttgatgttttagttaatggattaaaagcacagttaaaagcttcaaactatacgttaaaagattatctttctgcatatggaattgaagatgagaccacattaagagaccagtataagagcagctgtgaaagcacggtaaaagtattccttattgcagatgctatcgcagcagataaaaagatttcggtaacagatgaagacgtaaaagcgtacttcaatggggaagatactgcacaatatgaaaagcagtattccaaagcatatattaaccgaatagtgctgaataatcttgtgatacaggaaatcgagaaaaatgtaacagtgaaataggaatttttctcctacagccaaagtacagcccccgaagagagtctaacccctatatttgtgactttagtcgcagcggtttgaatgctcgctttaagcgctcacatccaaaccttgctccgaggccacaaatataggggttagactctcttcgggggcgtctttttgcctgcggcaaatttctatttatcaattaccttatagtggtcgaagcacagggattcatcataatatattttatctttggctgtgatttttgcctgaccgttttggacatcaatgattgttacggcacagttgtaaggtacatgttcctgccagaagctatcccggttttcgtataaagaatttaacatagcgcgcagagcacagccatgtgtggcaatgaggatagttttatcctggtaatctggatttgcaattaattcattaaagaaatcagcagttctttccatcacatcagcaacactttctccatcgggtgaaccctgataatgaaaggcatctgtatagaatatattataattaggatcaggaacttcaaaattattttcgagacagccaagcccctcccagcagccccagttaaattccatgatgcggcggtcttctataataggaattttacgtccaaaatttttctcagaagcagcaacagtaagttctcctgtttctcttgctctttttaaaggacttgtaataacaaggtcaaaaggaatctcttttagtgcttctccggtgataattgcaaggtcttttccattctggtttaacggttcatctgtccatccctgcaagcggcctaaagcatttagctttgtttctccatgacgtataatataaagcttcatatgtaaaattctcctttttaacgcattggataataaatacaaactaacacagaaaatattataacaataatcagaaggtatatcaaggaattctgatttgtcaggctgcggagcagacgaactcctgaagctaaataaagcatatttgtgactttagtcgcagcggtttgaatgttcgcttacagcgctcacatccaaaccttgctccgaggccacaaatatgctttatttagcttcaggagttctgtgcgctggcagctcagaaaaccagttggaggaatttggggattcctcgaaaggctgtgattttatgagaaaatacaatgaattcataacagtatgttaaaaagataatatttaaattcgatttttcaaagtttttatagcggatgtttatgtttactcctgcatcaacaaatcagtgaaaaaatttgagaaagtgaatcagagtaatatctttttataccatgttatagagaaaatgattttttacaaattcataatattctggagaatccccaaatcctctaagatgaattctgactttcctccaactgccaatgcacagctttcttcgaaggcgtctcctttgctgcgcaaatcagaacttctttacattagagataaaatcagctataatgatattaagtattactttgccttcttgcagaaggacagagaatcaggggtgtgaagaatgaaggtattattgtcgaatgtttcgaggaaaaatggatatatgattatagatgtctttttttcggtgttgtccgggatgaattatccagtattagcacacgatgatactatgcttaaatttattgatgtagatgagaagtttaagaagaccgaaattcgctatgattttcgcacccgaaagattatcatgggataaaaacatttggaggtttacatgaaagatttaaaaagtttaaaccgtgttttattaaagttaagcggagaagcattagcaggagaaaaaaagacaggatttgatgaagcaactgtattaaaggtagcagagcaggtaaagaagattgttgatgatggaatgcaggttgcgatcgttatcggcggtggtaacttctggagaggaagaaccagcgagaatatggaaagaacgaaggctgaccagattggtatgcttgcaactgtaatgaactgtatctacgtttctgatatgttccgccatgttggaatgaaaacaaagatatatacaccatttacttgtggtgcatttacagagcttttctctaaagatgatgcagtaaagaatcttgaagaaggtgttgtgactttctttgcaggaggaacaggacatccatatttctctacagatacagcaacagctcttcgtgcgattgaaatcgaggcagatgccattcttttagcaaaggcaattgatggtgtttatgacagtgatcctaaggttaatccagatgcagtaaagtatgatgagatttctcttgatgaagttctttccaagaagttaggtgttattgatcttactgcaacaattatgtgtcttgagaataagatgccattagtaatctttggtttagaagaagagaatagtattgtaaacacgatgagcggcaactttaacggaacttacgttaccgtataagaagccagaaatttattttgcaaataattcatacagatattggaaaaagcttgacaattaagtagggttattgtaaattagtatcacacagttacagagcatgaatataatgcaggaggacatatattatgataaagaagtttgaagacaagatgcagaagtctattgagagtcttgagagggagtacaattctattcgtgcgggaagagcaaacccacatgtattagataagattaaggtagattattatggaacacctactccattacagcaggttggtaatatttctgttccagaaccaagaattatcacaattcagccttgggagacatcccttttaaaggcaattgagaaagaaattatgcagtccgatatcggaattaatcctactaatgatggtaaggttatccgtcttgtattccctgagctgacagaggaacgcagaaaggaactcgtgaaagatgttaagaagaaaggagaggcagcgaaggttgctatccgtaacatcagaagagatgcgaacgattccctgaagaaagcgaataagaatagcgagattacagaggatgaattaaaggatcagcaggataaagtacagaaagctacagataaatatattaagactatcgatggaatgattgataagaaatctaaagagattcttacagtataatatcatggaaagcaaccaggcagccggcgtgactggctgtctggtttttcttatgtagaaaatgtacttataagattccttttgcatttgcttttgtggacggttttttatccgttacgttttagaacgtgtttgaaaaatcattccagcaatctgcacgcccaatttgcggtatattttgccttcattcagttgacgtagcccactacgccgctctcattcaggcaaaatctcccgcaaattgtaacacacatcttgcagaaagcattttttaaacacgctctagaatttgaacgcagctgataaaaatctttttacaaaattaagaatggagagaatctgcgagtacataaaaatatttggaggattacagataagtggaaaaggaattacatggaaagctgcttacaatccctgaacatgtggcgattattttagatgggaatggacgctgggcgaagaagcgttttatgccgagaaattatggacattcacagggagcgaagacagtagaacagatttgtgaagatgcgtgggatattggaattaagtaccttactgtatacgcattttcaacagagaactggaaacgtccagaaaaagaagtaaaggcgttaatgaagcttttaagaaagtatttaaaagattgtatcgaaagaacagctaagaataatatgcgtgtccgtgttattggtgaaaagagccgtctggatgatgatatcagagccgcgatcgatgaattagaggaagtgtctgcagcgaatacaggtcttaattttacgattgcgctcaattacggaagtcgtgatgagatggtaagagcgatgcatcatatggcacaggattgtaaagatggagcatttgatccggaggagatcactgaggagaaatttgcatcttaccttgatacaaaggatttgccagatccggatttgatgattcgaaccagtggggaacagagactttctaactggatgctttggcagcttgcttatgcagaattttattttacagatgtactttggccagattttgataaagaagaattaatacgggcagtggagtactataatactagagaccgccgttttggtggagtctgatagggaggacagcgatgtttaagcagagattaattagcggaattattctggtacttattgcttttgttacactgtattatggtggatttttgacattctttgtagtgggagctatttccctgattggtgtatttgagctattgagagtaattcagatggagaagtctgcacttggagtcattgtatatacgggaagtgtattgtattatttattattacttcttggattggaacagtatgtaatgccactggcattattagtattgattttgcttattgcagtgtacgtttttacttttccaaagtatgagatttctagtatagcaatctcttattttgcattattttatgttacagtgatgctttcttgtatttatcggattcgtatgctttctgatggagcatatatggttgttctcgtatttttgagtgcgtggggtaatgatacattagcatactgtacgggacgattaattggcaaacataagatgtctccgatattaagtccgaagaagacagttgagggagctattggaggagtaattggggcaggattgttaggatgcctttatggattatttgcgaaacagttcctttcagttaattacaatctaattgttgtatttggtatagtttgtgctgttggaggtcttatcagtattatcggagatttaggtgcttctgcgataaagagaaattatgatattaaggattacagtcatctgataccaggacatggaggaatccttgaccgttttgacagtatcatatttacggcaccgattatttattatatgttagtaatggtggtgggattaaaatgaaaaagatagcaatattaggttctacaggatctattggtacgcaaacattagatgttgtcagagaacactctgatgaattgcaggtagtagcattagctgcgggaactaataaagagcgtttaaaagaacagattaaagagtttcatccaaagcttgtaagcctttctgatgagaaaaaggcacaggaacttaaagaagaacttgcaggggaacaggtagaagttgtctgtggtatggaaggtcttattgaagtggcaggagcagacagcgcggatgttgttgtaactgcagttgtcggtatgatgggaatcttaccgacaatggaagcgattaaaaagggcaaggatattgctttagctaataaggagacacttgtaacagccggtcatctgattattccgatggcgaaagagtacggcgtttctattcttccggtagacagtgagcattctgcgatattccagtcccttcagggagagccgaaggcagcacttgataagattcttcttacggcatctggcgggcctttccgtggaaaaagtgcagagtttttggaaacagttactttggaggatgcactgaatcatccaaactggtctatggggccaaagattacgattgattcatcaacgatggtgaataaaggacttgaagtaatggaagcgaagtggctgttcggggtggattactcacagatagaagttgttatccagccacagagtattattcattcgatggtacagtatgttgatggtgcgattatcgcacagcttggtacaccggatatgcgggtgccgattgagtatgcgttattttatccggaaagaaggagcctttctggagaaagactggatttttcaaagctgtcacagattacatttgaaaaaccagattacaaagtatttagaggcttatctcttgcaattgaagctggaaagaccggaggaacgatgccgacagtctttaatgcagcaaatgagagggcagttgcaaagtttttaaaaggtgagataaagtatacggacattgtccgttccattgaaaagtgtatggatgcccataaagtatctgctcatcctgatttagaagaaattcttgcaacagagcagtgggtttattctatacttcagtaaaagaaaggaaaattcatgctgaaaatcattcttgcaattgttttatttagtgttattgttatttttcatgaactgggacattttctttttgcaaagaaaaatggtatttgtgttgaggaatttgcgataggaattggaccgactatttttggaaagcagattggagagacgaagtattcgataaagtgtctgccatttggaggatgttgtgtaatgcttggagaggatgatgactgtaaagatccgagagcgtttggcagtcagtctgcactggctcgtttttctgttatatttgcaggcccatttttcaattttattctggcatttgtgcttgccttatttgttattgggtttagcggggcagatccggcagtagctggagaaatttcagcagatagtggagcgtatgaggcgggacttcatgaaggagaccgtattgtaaagttagacggttcccgaatttataattttcgggagatttctctttttaattatctacacaaagataaagcggatgtagaggtgacgtatgagagggacggaaagcaaaagactgttacagttacaagaaagaaaacagaggctggaacctatgcttttggtatttctatgacggaagatacaaaggaaggaattatcggtacgctaaaatatagtattttagaggtaaggtatcagattaaatccacgttcctaagtcttaaatatttgataacaggacgatttaaactgaatgatctctccggcccagttggaatcgtgaatatgattggaaacacatatgagcagtctattgtgtatggtattaagactgttgtgctgagccttcttaactttgcgattatgctgagtgctaacttgggagttatgaatcttttgccacttccggcattagatggaggacgtctcgtatttattattcttgagatgattcgcagaaaaaaggtatcgccggaaaaagaaggaatggttcattttgcaggccttgtccttttgatggcattgatggttattgttatggcaaatgatattaaaaatatctttttcatataagtaaaactaaaaattatttaaaaatgtttatatctttgaataactataggatgtaaataaacacacagataaacttatcttgcgctatcctggctgatttatttggtttattccgcaggaaagagaaagtataagtgaggaaaagaggctgttgcggctatgttttgacaaagagaattatacttttatttaaaagaaaattctcacagtttgaagagatgcatcaggctcttttctggcaatagtgagaaatgagaagaggagtatatataatgtacagagaacatacaaaggaagtaagaattggcaatcgtgtaattggaggcggcaatccgattttaattcagtctatgacaaacacaaagacagaagatgtggaagcaacagtggcacagattttggagttagaagcggcaggctgtgatattatccgttctacagtacctactttagaggcggcgaaggcacttggcgagattaaaaagcggattcacatcccaatcgtggcagatatacattttgattatcgtatggcgattgctgccattgagaatggagcagataagataagaattaatccgggtaatattggttcggcagaaagagtaaaagcggtagttgataaggcaaaggaatataatgtgcctatccgtgtcggagtaaatagcggttctttagaaaaaaatattgtagaaaagtatggaaaagtaaccgcagaaggattagtggagagtgcattggataaagtaaaaatgatagaagacatgggatatgataatctcgttgtcagcattaagtcctctgatgttttaatgtgtgcaaaggcacatgaattattagcaccgaaatgtccgtatccgcttcatgtaggaattaccgaagcaggtacattattccgtgggaatatcaaatctgcaattggtcttggtattattttaaatcagggaattggtgatacaatccgcgtttctcttacaggaaatcctgtgaatgagattgcttctgcaaagcagattttaaagacgttagggcttcgtaagggtggaatagaagttgtatcctgtcctacctgtggaagaactaatattgatttgatcggtcttgctaatgaagtagaaaaaatggttacagaatttgatgatttagatatcaaggttgccgtaatgggctgtgtggtaaatggaccgggagaagccaaagaggcagatatcgggatcgcaggaggaaaaggtgagggccttttgataaagaaaggacaggttgttcgcaaactgccggaaagtgaattgttgtctacattaagggaagaacttgcacactggaatgacaaagcggacgaatagcaattatagaataggagcagaggaggattcatggcactaagattaattacaggaagaagcggacagggaaaaacggaatatctggtgcaggaagtaatccgcctttccatggagaatccgcagcagaaatattatgtaatcgtaccagagcagttcagtcttgagatgcagagaaaaatggtaaagaaacatccaagacatggcttttttaacatagatgtactgagttttcatcggcttgcctatcgtatttttgacgaatgtggatatcagccgggagaaatccttgaagatttaggagtatccatgatgcttcgaaagattctttcggaaggtgagaataattttctttattttaaaaaaagtatgaaaaaggcaggcttcattgatgagttaaagtctatgttaatggagtttatcggatatggggtaacctgggagcaggtagaggaagtttctgagaaactcggagagaataaagctctttctaacaaatgcaaggaacttggcagaatttatgaacattttgataaagcgatagagggaagatttatggtaacagaacagatacttgatgttgccagagaatttgccaaagaagctccaatgcttacgaatgcagtattttattttgatggatttgcaggatttaccccggttcagctggcatttttaaaggaattattaaaggttgcggggcagattaacgtgacaataacaattccagaatttgtgcccggacaaaggggaatgcctgaggatttattcacttccagtaagaagacaggggatgcgctgctaatgctctgtcaggaaaatatgcaggaagtagaagaggtcgtaaagcttgacacaccagtttctccaagatttataaataatccagaacttgcatttttagaaaaaaatctatttcaaaatagccggaagatttattcaaagaagatagaacgaatccatatgacagtgtgccataatccagatggagaggcagactatgttatgcacaaaatagagcagcttgtaagacaaaaaggttaccgctatcgcgattttgcagtgctttcaggagatgtggccgattatgcctctgcatttaaacgaaaggcagctattttaaatattccggtattcgaggatacgaaaaagaaagtctcctatcattcaggagttgaggcagttcgctccctctttcatcttgcacagatggaatattcttatgagagtgtgttccgttatctgaagtctggaatgtctaatcttatagatgaagatgctgattatctggaaaattatgtgttgtatgcaggtgttaggggatattccatgtggaagaagccattttacaggagactcaagaataaagacgaggcagcgataaaagcacttcttcttttacaggagaaattcatggaagaaacggaaaacttctgttcagttatgcgagataaagaggctagtgtaagagacaaaatagaagtattgtatcatacgatggtaaagctttcttttgaggagaagctcaaaaatcaggcgcaaaaagcggaggaaaacagtgactttgtaaaagctgctgagtataggcagttatatgacctcttactgtcgctcatggataaaattgtaatgattttcggtgaggaaaagatggcggtaaaggaacttgcagaaattgtggatgcgggtcttgatgcgctgggtcttggtgttgttccactgacaatggatcaggtggttctaggtgatttaaagcgtacccgtctgcatgaagtaaaggtgctgtttatcacaggaatgaacgatgggaagataccgccgaatatagaggacagaggacttctcagtgatgaggaaaaagaagttttaaaaaattgtggtatttctttatcacagagcctgctagaacagtcgatggaagatgaattttatatgtacatggcatttgccaaaccaacagatgaattatatttttcttattctgtgacagatagtgacggttcggcattgcggccttcacttcttcagaaaaatataagccagcttttcccaaagttgaagagaaaacagtatccagaagaggagcgaagatattactttaatctggaggacagtcgggaatttctgatagaaagttttcttcaggcaaaaacagaacccgaaaaagtacggaagaacagggcttttgttatgctggcaaagtactggttagagcagagtgagggaaggaaagaactggaaaaatatggacattggattgaaaatgcatatcaggaaccagaactttcagaagaattgctggagcagctttacggaaaggaactttcaggaagtgtaacaaggttagagcgatttgcagcctgtccatatcaatatttttgtatttatggtctggaactaagagaaagagaagaatataagattcgtcctatagatcttggtaatctttttcataaggcattggagtgtttttccagaaaggtaaaagagtcggaatatagctggaagaatatcccggatgaagtgcaggaacaatatatttcagaagcgctgcatacagcgatggatgagaatctgagtgatgtgttccagagttcttctcgaaatcagtacaaaataaaaacagtagagagaattatgaaaaggacaattcaggttctgcgcgtccatttgaaaaacagccagttcgaaccagatagatttgagcttagttttggaaaaaacaaaaagttaaaagaggcggaagtcccgctcgaagatggaagaaagatgtttttgcagggtgtgattgacagggtagatacctgcgaggatgatgatgagattcttatgaaagtcatcgactacaagtctggaatgaaaaagtttgaattggaagacttttattatggactggagatgcagcttgtcatttacatgaatgcagcggaagaaatttataaagaaaatgaacaaaatcccgataataaacctgttgttcctgccggaatcttctattatcagttacaagacccaattataaaggcagattatgcagaagaaagcgaacttcttaaaaatttccgactgtctggcatggcaaatagtgatgcggatatactgagtaagttagaagagggcagtgatggttttgtatctatgccgattcgtctgaaaaagtctggagaaccatataaaaattcttcagtgatgagtacgcaggactttcattatatgggagcttatgcccggaaaaaggcggcagaattaggcgagagaatttataaaggagagattcatccaagaccgtacagaaataaaaaaggaacagcctgtgattactgtcctttcgcagatgtctgtggatttgatccgaagctgccaggttatgagtaccagagtttccagggaatgtctgtggaggaagtcttagaaaaaatcagagaggagggagaatagatgaattacacaaaagagcaggaacaggccatatttttaagggataaaaatatcatggtatctgctggagctggtgcgggtaagacaagagttcttgtaagccgtatggcggaacttattatggatgagaaaaatcctgtagaggccgatcggtttcttgttatgacatttacgaacgctgcggcagcagaaatgaaagagcgtattagtttggatttagaagaacgtctggcaaaagatccggagaatcactatttaaggaagcagattcgaaagataagacaggcagatatttcaacagtacacagcttttgtaatcatttaattcgtacacattataatgaactttctattgacccttcctttcgaatcggggaggaaggagagttgttcttactccgccaacaggcaatagaacaattgttagaggaggcatatgcttctggaagggaaagttttgtgaagtttgcagagtcgtatgcaccaggaaaaagtgataaggttttagaagaactggtaggagacttatatcgcttctctcgcagtttccccaatgcttctttctggtttgaaaagacaaagcaggaagcattgcagcttgcagaggcaaaagagtgggacaattccccagcagtaatgcttattttcttaaaagcgaaaaaggaacttttgcaggaaaaagaagcgctgtcaaagctgttaaagaatatagcaggggaagaagttccagaaaaatacggtgttcttttacaggatgtatcagagtatgtggaggcactttcacagacagaaagttatgatgcttattatatggtattatctcgtgggcctgtaccggcctttccaagagcgacaaagaaagataaggaatgggcagattatgagatagtaaaagaatggcaccaggaggtaaaagaactgctgcaaaagcaaaaagaaacagtatttactgctccggcagaagaactgcaaagagaggcagcaggtatttatcctcttttagaagaatatattgtgcttgcacagcgttttgaagagatttatcttgcatataaaaaagaaaaaaatgtatatgattttgatgacctggaacattttgcactggaactcctggtagatcattatgatgagggagggcaggcctatccttccgaaacagcaaaaacattagcaaaaaagtataagatgatttttgtagatgaatatcaggacacgaatcttgtgcaggaaacaattttagaaatgttatcagaaaaagataataatacattattcactgtaggagatgtaaagcagagcatttatcggttccgccaggcaagaccagatttgtttttaagaagaaatgaaaaatatcataatgaggaagagggagtttctatcgaacttcgagataatttccgaagtgcaccgggagtactttgttttacaaactatgtattttcccgtttgatggaaagagattttggtggtgtagactacaatgaagagacagctcttcgtgctggtgagggtggcccaatgctggaagataaagaaacttcggaactactattctttgtaaaagacagtgtccagaccttagaggaagcaccggaagatgtactgacggagacggctcttatcacaaaaagaatacaggaactgatagaagaaggatatcattacggagatattgtaatacttttacgttcaggagccggaagaatggagccaatggcggagtttttagagaagaatggaataccggtaagctgtgaaaacaaaacaggatattttcatacaagggagattacgattatactgaattatctttctgtggtagataatgtgtatcaggatatcccgatggcttcggtcatgctttcttctattggaggttttacggaggaagaactgactaaacttagaattctcgtaagagagccaatgagagagcaatatactttgtatgaccttatgtgcctgtatttgcaggagggagcagaggaagaactacgagcaaaaattcagcatttttacaaagatttacaatatttccgcgagcaaaaaaaggagcagccattgggagtgctgttatgggatatttatcagagaactggtttttactatgatgtacagttaatgccggatggggcaaaacgaaaagagaatcttctgatgctcttaaagaaagcagaagattacgaaaaaacggtatttaaaggattattttactttaatcgatatatggagcagctcaagtcttacgaaattgagctgggtgaggccggaagcggaacagagaatgaaaatgttgtaaaaattatgacaatccataagagtaaaggtctggaatttccagtagtattcgtcagtggattatcgaaaaagtttaaccggatggatttgactaaaccgatgctctgtcatccagaactgggaattggaatggaatgtgtcaatatcacattgcgattccatcatccgtcgcttatgaaaagggcgattcaggaaaaagtgtggaaagatactttagaagaagaaatgcgtattttatatgtggcgatgacaagggcaaagagaaagctgattcttacaggaataataaaggcacaggacttagaagcaggacttaggctccaaataaatacacagaagtggagagcgacaagcgctatggactggcttcttcctatactggcagatcaatttcggagtacacagtcggaaaagtcagaagagagggaaggttttttgaaaaatcaggagacgcagaaacaggcgcactctgagggagtaactgccagctggcttaaggcaagactggttaactgggaagaaatccttccattttttgagaaggaaaggaaacagaaagaagaattttcttatcagatttttatggacacggttgtgattccagcagatgtatctatggtggaacaatcattttcttatgaatatccaaatcgtgacgcaacaaagtggaaaagaaagtattctgtttctgagttaaagacactttctcagaccacattgccagaagaagaatcatccattatgctgccagaacaaaataactttgaggaagaagttaagatgccggaatttttaaaagaagaaaagtctgagattgcagcaactgccagaggaacgattatccataagattatggaattacttccttttggacagattcagacgaaaaagcagctttttgaatggatagatgcattgaaaggcacatatcctgaatcagaaaagatttctgcaaagtggttatacagggcgatagaagcgtttcttttctctgaaataggagaaaaattatctcaaatggacagacagggaaatttgagaaaggaactgccatttacagtcgggcttcccgtttcattaatgaatgcagatacgcaggcagaagatactgttgttgtacagggaattattgatatatgcggagaggcagaagagagtttgtggctcattgattataagacggaccggataaaagaaggggaggagagtctgcttcttgaccgatatgggaatcagatgttatattataaagcagcccttgaacagattttaggaaagagggttagcgagagttatttatattctttttctctgaaaaagtttattcccgtgaatttacaggaaagaagtggagagaatgcgtaagtttttaaaatttttatcacagcgtattgttatcgtaacttttcttatctttttacaaattatgtggtttgtcggaatgtttctaaaagtgacttcctacagtcagtatattactgcggcatttaaaatactgagtattttagtagtgatatacattatgaatcgaagtgacaacccgtctgttaagctgggctggattgttgttattttgctgtttccactttttggaggacttttgtatctgacgattggaggaaagcagccgatatcctatcttcgtaggaagttagagccaatgattgaagaaagtgcaagacatttaaaggctgacccggagatagagcaggagttgaaagaaaaggacggcagtacggcttcgcagatttactatctggagcaccagtcaggatttcccgcttacaaagactcaaaggtggattattatccatcaggtgaagactgctttaaagtaatggctgaagaattgagaaaggcgaaggaatacatttatctggaatatttcattatagaagagggtatcatgtggaataccattctggatattttggaagaaaaggttaaagagggagtagatgtcagagttatgtacgatgatgttggctgtatctttaacttaccgtcacattatgcggatttccttcgcaaaaaaggaatcaaatgtattgtatttaaccgttatattcctattttctctacggtatttaataacagagaccatcgtaagattcttgttattgatggggatgttgcgtttaccggcggaattaattttgcagatgaatatattaatgaaaagcagcgttttggatactggaaagacaatggtgtgcggataacgggtaaagcggtttacagcatgactcagatgtttttgcagatgtggaatgcctttgcattagaaaaagataaactggattatgagaaattttgtttggaagatgtgaggccgcttgctaaagaagaaagaggaatcgttcttccctattcagaccatccattagattcggagtttgttggagaaagtgtatatatcaacttaatcaacagtgcacagaagtatatatatttctttacgccgtatctgattattgataatgaagtggttaccgcgttaatccttgcagcaaaaagaggggttgatgttcggattatcacaccgggaattccggacaaaaagatgatatttctggtaacgcagtcttattatccacagcttgtagagggcggtgtacagatattccagtaccggccaggatttgttcatgcaaagtgtgcggtatgcgatgataagattgctacagtaggaacgattaatcttgattaccgcagtttgtatctgcattttgaaaatggacttttcttatataataatgatactgttatggatataaagaaagatatattagatacattagaagattgtaatcgtattatgccggagatgtgtaagaaaaatatgtttttcctgctcctacagggaatactgcgaatttttgcaccattattataaaatgttagaatacaatgggggaattttacggtatatttgctgcggatttcttatagaaaacgaggaaagataaatgggaagctacgaaaattttgcgagagtttatgatgaactcatggataacgtgccctatgaagaatgggcagatttcattttggcaattttaaagaaaaataaaataacagatggacttgtattagagcttggttgtggaaccggaaagttgatgtcacttcttggaaatgctggattcgacatgattggtgtagataattcggtagatatgcttcaaatagccagagagaaaacttccccggagtttttgtatcttttacaggatatgagagaatttgagctgtatggtacggtgaaggcggttgtatccgtgtgcgacagtgtaaactacattacagaaaaagaagatctgacagaagttttccgtctggtaaataattatcttgacccaaaaggactctttatatttgatttcaatacggattataaatatcgtgatatgattggggagacagtcattgcagaagatcgggaagacgtaagctttatctggtttaatgagtacgatgaggaaagtcagttaaacgatattgatttgaaagtgtttgtgcaggaagacggagattgttatcggaagtttcaggaagaacatatccagagaggatattctttacaagaaataaagcagatgttagaagaaagcggccttgtatttttacaggcatttgatgaatacagcaatcaggaaccacggacagacagtgggcgtatcgtagtggttgcacaggaaaatggaaaagagaaacaggaggaaacggaatgagtgattatattataagaggaatggcagcagataaacaggtacgtttttttgctgctaatacaaaagacttagtagaaaaagcaagacggattcacaatacaagccctatcgcaacggctgcacttggaagattgatgaccggaacagcgatgatgggaagtatgtgtaagaatgacagtgatattgttaccgtacagattaaaggagacggtcctatgggaggacttgttgtaacttctgatgcaaaggcaagagtaaaaggatatgtttacaataaagacgttatgctgccaccgaatgcacagggcaagcttgatgtaggtggagcaatcggaaatggtgttcttactgtaattaaagatttaggtttaaaagagccatattctggtcagacgaacctgataacaggagaaattgcagaggatttaacctattactttgcttcttctgaacagattcctacttccgtagcattaggtgttcttatgaataaggagaatactgtaaggcaggcaggtggatttatgattcagatgatgccttttgcaagtgatgaagtaattactgcattagaagagagattaaaagattttacttcagtaacttctcatcttgaccgaggagagacaccggaagatatgatggcagaattatttgaaggaatggacatgacgattgaagataagattcctacagaattctactgtaactgttcgaaagagagagtttcaagagcggtaatcagtgtcggcaaaaaagaactggcggatatgatcgaagaaggaaaaccaattgaggtaaactgtcatttctgtaattcccattataactttagtgtagaagaattagaggaaatgttaaaggctgcaagataacctgcagcctttcaaatctgatataatacatatgataaagagttctctatgcttcctctgcttcgtcatgtgagtggaacttcagtggaatatatccacgacgaacctttgtctgagaggaaggtttcgcttcttctttttctactggaacgaagtcttctaaatcgtcaaggtcagaatcgaagatatcttcttctgcctcatcgggagcatcgtctccgcagaaagaacagcccttgatgcggtcttttaaaagataaagtaccagagctaaagttgctgcaaagcctatcacagacaatgcaatggaaataatacgatgttttttcatgattacgtcctttctgtagtcaatcggctgtgattcctcaggcatacccatgaagaatcttccgaatgaaagtattggtatgattgttatattttattctaatactttttaaaaagaaaatcaattattatcttattgttgcaagaaaacagaggcaaaaaatataaagtgtactgcctgccatgaggactttcagttaaataacataaaatatcagtgataaagtgcaggctgcctgaatgattttttaaacacaatctagaaaaagtaaaaagataaaaagtataggaattaagaaaggagaatagtaatatgagctatgcagataagttatttatcgatatgtgcagtgatattatcgaaaatggatacagtacagaaggggaaaaggtaagaccaaaatggccggatggaacttatgcgtatacaattaaaaagtttggtgtagtgaatcgctatgacctttctaaagaattcccggcaatcacacttcgaaaaacatatatccgttccgctattgatgagattttgtggatatggcagaaaaagtccaataatgtacatgatctaagcagtcatatctgggacgaatgggcggatgaagatggctctattggaaaggcatatggttatcagcttggaaagaagcataaatataaagagggagagatggatcaggttgacagagttttatttgatttaaaagagaatccattcagccgcagaattatgacaaatatttatgtgcatgaggatcttcacgaaatgaatctgtatccatgtgcatacagcatgacatttaatgtgacaggtaaccgcctgaatgcgattttaaatcagcgttctcaggatattttagcagcaaataactggaacgtggtacagtatgcggcattgctcatgatgtttgcacaggtaagtggctttgagccaggggagcttgtacatgtcatcgcagatgcacatatatatgaccgtcacattccaatcgtaaaagaactgatacaaagaccagtctatccagctccgaaggtcactttgaatccagaagtaaaagatttttacaagtttacagtagatgattttacgattgaagattatgaggcaggaccacagattaaaaacattccgattgcgatttaaaaagcagattattaaatgtgaatgttctgacagtatttctttgatgatatagagcagattaaataaaaatggaggaagaaagatgaagcttatcgcagcagcagataaaaattgggccattggaaaagatggagagcttttagtacgcatttcagaagatatgaagaactttagtgccataacaacaggtaatgtgattgttatgggaagaaagaccttagaaagttttccgggtggcaagccacttccaaatagagtaaatattgtacttactcatgaaaaagattataatggaaaaggtgcaatcgttgtgcacagtgaagaagaattgtgggaagaactttcaaagtatgatacagacagtatttttgtgacaggtggagaaagtatttaccgtatgctgcttccatactgtgatacagcatatattactcgtcttgattatgcttatgaagcagatacatggatgccaaatcttgataaggaagaacattggagtatggtagaaaaaggtgaggaaagatattgctttgatcttatctatcattttacaacttataagaatgagagaccagcattacattaatgacaatgttgacttgatgtgggatatccatagatatttaaattctacatcaaaataaatcaaaagaactcataacgaaaatacggagaaaaaaaggggataatacaatgccatatattgaagtaaagttagcaaaacaggcatcaagaaaacaggagagaattcttacagaaaaattaggagaggctatcacaagtgtaccgggaaagacagcagccgggcttatggtatccatctcttctgatgaacacatttataaaggtggagaatttttagaatatggtgcttatgtaaatgttgtatttaaaacaggtgtgacaagagcagactgcgagaaatttaatgaggcaatctttacgattatggaagaagatttaaaagtaccaaaggagaatgtatatacgacgttccagtattgtgatgactttggtgtgcagggtaagttcctgtaactcttaatacttcttgataataaaatctatagcgatttataaaactgtgctggattgtctgtgatgttttataaaagtactatagtataattggaatatgatataataactataaaaaggaaaacaatgtcctttattgatgataaggtatattagagcgtgtttcgaacaggcctaaaagaatggtgaataaaatatgagcagagaaaaagaagaattacagggagtaacactccttggaaatcagaaaacgaaatatccgcaggattatgcgccggaaatgttagaaacttttattaataagcatcaggatcatgattattttgtaaagtttaactgcccggaatttacgagcctttgtccaatgacagggcagccggattttgcgacaatttatatttcttatgtaccagatgtaaaaatggtagagagtaagtctttaaaactgtatttattcagttttagaaatcatggagatttccatgaagactgtgtaaatattattatgaaggatttgattaagcttatggatccaaaatacatcgaagtatggggcaagtttactccgcgaggaggaatttctatcgacccatatacgaattacggaaagccgggaacgatgtgggaacaggtagcgacagaacgtcttgtgcaccatgatttgtatccggaaaaagtagataatcgataaaaatacgaacaaatttttgcgaacgcttgtttttatagaacaaatgtgctatactaacgatacaagaaagaattttttatcagttttatagattttataattagaaaggattagaatagcatggcagcaagtaagaaagataatgtgaatgcaggcagagtagaatatcttggagatgatagagagggcaagcttgccgcactgaataatgcggttgcagcgattgagaagaattatggtaagggctctatcatgaagcttggagattctggtgcaaatatagatattgaggcgattcctacgggttctatcagccttgatgtggcattaggtgttggtggtgttccaagaggacgaatcatcgaaatttatggaccagaatccagtggtaagacaacagtagcccttcatatgattgcggaggcacagaaaaggaatggtatcgcaggtttcattgatgccgagcacgcgcttgaccctcagtatgcgaagaagattggcgtagacattgataacctttacatatctcagccagataatggagagcaggcattagagattgcagagacgatgattcgttccggcgcgctcgatattgtaattgttgactctgtagcggcattagttcctaaggcagagattgagggagatatggatgaccagcaggttggtctgcatgcccgtcttatgtctaaagcgatgagaaagcttacaggtgtaatcaaccgttctaattgtgccgttgtatttatcaaccagcttcgtgagaaggttggtattatgttcggtaatccggaagttactactggtggacgagcacttaagttctattcttctgttcgtatggatgtgcgaagagtagaagctatcaagcagggtggcgagattattggtaatcataccaaggtgaaagttgtaaagaataaggtagctcctccattcaaagaagcagaatttgatatcatgtttggtcagggaatttccagagaaggagatctgattgacttagcagttaaggtggatgcagttcagaagagtggagcctggtatgcctataagggtgagaagattggtcagggaagagagaatgccaagactttcttaagagagcacccagagattatggcagaagtggaagttcaggtaagggaatactataaccttcctacggatacagttgtagagtctgcatcacaggaagaaggccagcctaaagcaggagataatcaaaacggtcagtttaacagcattacgacggaagagtaagacatgcagtataagattacactgacagatacaggtaagaagaaagtttacgtgaatccgggagtaagagagggaatctacctctatcccggagagataaaaaagcttcggttagaagacggaagtgagttagagcaagacaaattcgagaggattcgtcttgaatacgctttgccaagagcaaagcacagggcaatcgctattttagcaaaaagagataagacagaacaggaacttagagagaaactgttacagtcccttacggatacgcagtctcttgaagaggcaattagctatatgaagtcttgtggttatgtggatgatacccagtacgccagagattatctttactttaagaaggggcgtaagagtttcttgcagattaagatggaactgcagaaaaagggcattcctgcagaggtattagaaacagtctttgaagaagaaggcagccagcagatggaagatatactagagcaggctcgaaagtatatgagaaagttcccagaacttgatttcccagccagacagaaagtttatgcacattttgcaagaaagggttatgcaggggatctgattcgggaagcgatagataagatagaggaattagaagaataaaatttaaatctcaatcattttttgctatgtataacttttatgcaaagaggaagttatttccaacatgatttacataatctggaattgagcagaagttttttttatcctcttacagcaagaagactccgacctctaaggtgggagatgaattgcgtctgctacctgcttgatagagcatcctgattatagtatagtatctttagtcggataataaaaaattgagataataacgcacatttagtattcttactatactatcatcttgcgcttgtggttaagtatcgcaggcggtttttcgaggaaaaggaagtggcatggtggcaaacagagcatataaattcagaatatatcccaatgatgaacagaagattttgtttgctaagacttttggctgtgtcagaatggtgtataatcattggcttgatagaaagatcaggcagtatgaggagaacaagacaaacgtaacatataccatttgcacaaaagaaatggctgcaatgaagaaaacagaagaatacggatttttaaaggaagcagatagtgtcgcattacaataatcactcaggcatcttgatacggcatttcagaactttttcaaacagccgaaaacaggtttcccaaggttcaaatcaaaaaagcggaataaaaacagctattccacggtctgcatcaatgggaacataactctgtctaatggatgtttgagattacctaagattggccaagtccggttaaaacagcacaggattattccagaggaatacagattgaaatctgtaacagtaagtcaggcaccaagcggaaaatactatgcaagtattctttttgagtatgaagatcaagtacaggaaaaggaactgcaaaagtttttaggtctggatttttccatgcatgaattatatcatgacagcaacggtaaagaacctgcctatccagggtattacaggaacgcagagaaaaaattagcgagagaacaacgtaagctttctaaaatgcagaaaggttcaaacaatcgcaataagcagaggcttaaggtggcaaaacttcacgaaaaggtttccaatcaacgaaaagactttctgcataagcagtcaaggcagataaccaatgcctatgattgcgtatgtatagaagatctggatatgaaagcaatgtcacggtcgttgaaatttgggaaatctgtttcggataacggctggtaaatgcatgaccttgacacaatataacacaaccgtgggacacacggggatagctcgcttatgcttagcacggtagtgctatcgaacgagaaccaaacttgccgaggatgggaagccccaacctctataggtgggggaggatgtcacatagaatataaataggataaatttgccaaagtttacgtcagcagaacataaaaattaaagtatacttgctgataacaaggaaaaacctgaatatatttaaatttttggcataagtaatattatataggataaaacaaccaaataatctgtgcagtttttataatagattcatattatacttgactttttgtcaaaataagtatagaatctaagtgttgtacttttgtacaatgaaaactaaataaggaggtgctcctgtagatatgtcaccaattgctgtgattattgtcctgattgcagttgttctgactgccgttatttctgtttttgcaacgattgcttaccgtaagagcgtttcagaagcgaaagtaggaagtgcggaagaaaaggcaagagagattcttgatgacgctttaaagactgccgaagcgaagaagagagaggcattattagaggctaaggaagaatctttaaaagctaagaacgacttcgagaaggagagtagagaacgaagaatggagcttcagagatacgagaaacgtgttcttaataaagaagaaacactcgatcgtaagtctgatgcattagagaagaaggaacagtcccttgctcacaaggaaagttctctcgagaagcagaaggtaaaagtcgaagaattacacgaaaaacgtctgcaggaactggaaagaatttcaggtttaacctctgaacaagcaaaagattatctgcttaaaactgtcgaagatgacgtaaaaagggaaatggcggtcatggtcaaagagatgaagactagggccaaagaagaagcatccaaaaaggcgaaagagtatgtcgtaacagcaatccagaagtgtgcggcagaccatgtagctgagacaacaatttctttagttcagttaccgaacgatgagatgaagggacgtattattggtcgtgaaggccgtaatatccgtactttggaaacattaacgggagttgatttgattattgatgatactccagaagcagttattttatcaagttttgacccagttcgcagagaagtggcaagaattgctcttgagaagttaattgttgatggaagaattcatccagcaagaattgaagagatggtggaaaaggcacagaatgaagtagagcagacaatgagggaagaaggagaagccgcactcttagaagtaggtgtgcatggaatccgtcctgaattggttcgtctgcttggtaagatgaaatatcgaacaagctacggacagaatgcattgaaacattccatcgaagtagcccagttatccggtttattagccggagagataggtgaagatgtacgtttggcaaaaagagccggtttactccatgatatcggcaaggctgttgatcaggaaatggaaggctctcatatttcaataggtgtggacttgtgtaagaaatacaaagaatctcctgttgtaattaatgcggtagaatctcaccatggtgatgttgaaccaacaagcctgattgcctgtatcgttcaggccgcagatacaatttctgctgcaagaccaggtgccagacgagagacattggaaacttatacgacaagattaaaacagttggaagatatagctaactccttcaagggagttgataagacttttgccattcaggccggtagagaaattcgaattatggtagttcctgaacaggtaagtgattccgacatgattttattagcacgggatatttcaaaacagattgaaagtgaattgagttatccaggacagattaaagtcaatgtaatccgtgaatcgagagcagttgactacgcaaagtaagacaatagtcttataagcgagggctgatacagattaaaataaaagcaaaatttctgagaagaaattttgctttttttattacagacaaacacgctctggcaggcaggtagcctttcgaaggagtctgttgattaaaattaaaaatcataagatacttcctcatgaatatatttattataaatatctttgcagggaggccattatgtattatactattgagggaaaaagagttcttggaattttgtacatagcaggattgataacaggaacacttttttttaatataacaataaaaatgcaggtatttaaagtttctgattttcttgattttacagaatatatgaagatgcttgagaatatagatttagctatattttgttcctatgtagtatttgtgcggtttcgacagttattactattttttgtgggtttatttttattttcaccatatatagtgttttgcctgtttgattatggagtttctgtatttaccggaatattgatttcagcaatggtattaaaatatggatggacaggcttagttggtggaacatgctttttatttccacaatattttttttatggaatgatttttgttatagtatatatttacctgtttcgaaatgcagctatcggaaacttctatacagtcatttcaagaggacggcgggggacacacacattactaaaagacaggattatcataattttacttataatagggttgttttttgtgggatgttacatagaggcatatatcagtccagctatattaaagaagatttttggtatttttacataggattgtgttcgggtatggaaaatataaagattttcatgtataataattaattagcacagaatcctgtaggacaggattctttcttataggcagataaatgaatacaaaggagagttaaagtgcacacaataagaaattatattatggcagagtctctcgaacaggcgtgggaactgaaccaaaaaggaagaaacaatattattattggagggaacctgtggctgaagatgggaagaagaaatattattaatgcgattgacctgtcttcgcttggattagacaagatagaagaggatgaaggtggctttcggataggctgtatggcaaccttacatgatattgagacgcatgaaggtctgaacaaagagtttcagaatttatttaaagaagcagttcgtcacattgtaggggtgcagtttagaaactgtgcgacaataggcggaagtatttttccgaagctgggattttcagatgtcctgactgcatttttagcctgcgatacacaggttattctttataaaaaaggtgaagttccattaagagaatttatttatataccaacagataatgatattttgacacatctttatgtgaaaaaagacggtagaaagactgcatatgaaagctttcgaatgacagagacagattttccaacaattacctgtgctgtggcaaaaacacaggatggctttgaaaccgttcttggagcaagaccaaagcatgcggaagttgtagtagatgaagtggtagcagatgcattttccagtgaagaggtagcagattatgcaaaaagagtaatcggaaagcttcagtatggcagtaacatccggggaagcgagcagtacagaaaacagttatcaaaagtattgattggccgttgtatttcccggctcacggaggaatagacagatgataatagatttatttataaatggaaagaagattcaggcagaaaccgctccagatcagatgctgatagactttttaagaggactgggttataaaagtatgaaaagaggctgtgatacaggtaactgtggactttgtaccgtgtggatggatgagaaaccagttctttcctgcagtgtgccagcggcaagggctgcaggacataagattacgacattagagggtgtgcaggaagaggcagcagaattttctgattatctggcgaatgaaggagctgaccagtgcggatactgcagtccgggtttgatcatgaatgtattagcattaaaaagagagattccaaatccgactatggcgcagataaaggaatatttatccggtaatttatgcagatgcacaggatatcagggacagtaccgcgcccttgcaaaatattttggagtggaggagtagtgcgaaagatggaaaataccagatttgtaaataaaggaatcgtaaagaaagatgcaaaggtacttctttctggccgtccggtatacacagatgatattgccccatcagattgtctggtggtgaagttacttagaagtcctcatgcacatgcatggattgaagatatttcaacagcagcggcattaaaagttcctggaattgaggctgtttttacttataaagacgtaccggagaagagatatacacaggcaggacagactttccctgagccaagtccagatgaccgtctgatacttgaccagcatattcgatataatggtgacccagttgcgattattgcgggaaaggatgagaactgtgtcagtcaggcaatgaaaagaatcaaggtaaaatataaagtattagagccattgcttgattttacaaaggcgattgataatccgattattattcacccagaagataattacgtcgtaaaaagtgatattggcaatgatgtaaagagaaatatctgtgcttctcagtgcagaggaaacggagatatcgacaaagttctttctgaatgtgattatactattgatcagacgtatcacataaaggcagtaagccaggcgatgatggaagtattttgtgcttttacatccatagatatttatggaagaattaaggtcatctcttccacacagattccattccatgccagacgaattattgcccgaggacttaacattccaaagtctaaagtcagagtcgttaaacctcggattggtggtggatttggtgcaaaacaaaccgcagtaatggaaatttatccagcttttgtcacttataagacaggcaagccggcaaagcttgtatttacgagagaagaatgttttattcagggttcaccacgtcatgagatgcaggtgcatgttcgtttaggtgcagataaaaacggaaaaatccgtggaattgatttatcaacactttctaatacaggtgcatttggggaacatggcccgaccacggttgatttgtctggaacaaagtctttatccctttataggatggaagccttccgttttaaaacagaagttgtgtataccaatgtattatctgcgggagcataccgtggctatggtgcaacgcagggaatttttgctgtggaatctgcggtaaatgaactggcgcataagttagacatagacccgattaagcttcgtgaaatgaatatggtacgggaaggtgaccttttaacaaactattttggagaggtgacaaattcctgcaatcttgataaatgcgtggccaaagtaaaagaaatgattggctgggatgaaaagtatccatatgtaaagaccggtccgcatacagttcgctcggtaggaatggcaatggcgatgcaaggctccggaatcggtggtgttgatgtcggttctgtacagcttaaattaaatgatgacggattctatactcttatgattggatgttcggatatgggaactggctgtgatacgattcttgcacagatgacggccgatggtcttggctgtgaatttgatgatattattgtgcggggcgtggacacagatcagtctccgtatgacagtggttcttatgcttcaagtacaacttatgttactggtatggcggttgtaaaagcctgtgaatccatgcggaaaagaatctgtgaagaggcagcggcaatcatgggccttaaggagaatgaagttgaatttgatggagagactatcagcgagaatgataatccagagcataatatgactctgtctgacttaattacaagtttacaagcgggaaatggtcatatcattgaggttactgaatcacatacctctccggtatctccaccaccatttatggcaggagcagccgaaattgaagtagatttggaaaccggaaagattactccaattaattatgttgctgcggtagactgcggaaccgttataaatacgaatcttgcccgcatacaggcagaaggtggtcttgtacagggacttggaatgacactctatgaagatatgcagtacacaaaagccggaaagatgaagaatcgtaacttcatgtcttataagattccgacacgtcttgatatgggtaacatcaaagtagaatttgaaagcagctatgaagagacaggcccatttggtgcaaagtccatcggagaaatcgtaatcaatacaccggcaccggcaatcgcagatgctgtgtataatgcaacaggacttcgtttccgcacacttccgattacagcggaacaggttctgatgggacttttagataaagaagaagcgtagaggaatgggagagaacacgcagaataaaaaaattgctatcataataatggcctcgggttatagcgaaagatttggttctaataaattattagaatcttttctggataaaccactttttacttacacagtagatttggtggcttcctgtcaggcagaaatgaaaattattgcaaccagatatgagccagtcatacagtatgtaaaggagaatgttccttcgatgagtatcgtatggaacgcacatccagagcgggggatttctgaatccattcatttgggaatccgctatttaaagcagcaaaaagattatgaagaatatgctggatgctgtttcatggtctgtgatcagccattattacaaaaagaaagtatgcaggagctttttaaaagcttttatacaaatccggaaggtatccatatgtgtgtaacaaagaaaagagagggaaatcccgtaatatttcccaaacaactatttgatgaacttatggcactcacgggagacaagggaggaaagcgggttgccaggcagcatcctgaactggtacataaagtgtatgtagctgaaaaagagttatcagatatggattacaaagaggataaaataaatcttgaaaaagaacataataaacataatatgaggtgaaaaaagtgaaattactggaagaaagaattaaaaaagatggaaaagcattaggaaagactgtattaaaggtagatagttttatcaaccatcaggtagactctgaatttatggatgctctgggaaaagatttcgcagagcatttcaaagactgcggaatcacaaaagtgtttacaatcgaaagttcaggaattgcccctgcattaatgacagcaaaatatcttgatgttcctatgattattttaaagaaacagacttccaaaatcttaaatggaaaggtatatcagacaagagtaacttctttcacaaaaggaacgagctatgagctgacattatatcaagattacattgatccatctgataaggttttattaattgatgacttccttgcgaatggagaagccgctatgggagccagccgcctcataaaagaatccggagcagaattatccggtattggaatcttaattgaaaagtctttccagaaaggaagaaagagacttgaagatgctggatattatgtttattctcaggcaagaatcggccgtctcgataagggagtaattgaattcttaccagaagatgctccagtgttagagggagtagacgaaaaagagttactggataaataggaatttgccgcaggcaagggagactctcttcgggggctggctttggctgtgggagaaaaattgctatttattgttggaatgatttgaggaatcgccagaatgttttggctttcggtggagttgtttttgctgagaatggattattggtaatagttcaccgataatatactcctttttcttattaattgtgtgttaatcttgtaagatttgatttcccggattatttctatccctcctgatttcttccacaaatctttccactaatttgcccgggcagccaggaaacagaagtccgagaatcaaatcatctatatttgtggtctgggagctacgagactataataaaatgttagaaaaggccgacatgaagagttattgattttgactcagttgtacaaaacacaaagtcgtcaaaatcaataactcttcatgtcggccttttcttagaagacgacttctcgtggcgacgaaaagcacaaatatagatgatttgattcttagacttcgtctgtttactcaccccggtaaattcctatttagtttatgatatagttgttttttacagatatgatatgagagcaaattcccttagtttgtagttgatttcttaaagtaatcacttctgcgagtgctttttcatcgagtatatctgcctgattaaagatgatacaaaatttctgggaagtaatatttttgcgaagccctttttcggaaaggcacagtcggtataaaaagtcagtagtaacgatgtctgcagactgcaatgattttataaaataattatctaaagaagtaagattcggaagtagttcgtaacgaaaaagtgtttcttttattggttttccgaggcaggaaagtccgattacgccgattacggtatctgtttttggaaaaaagacgggttccccatcctttggtagtttgataggaagtctttttgaaccatctccttcacataagatttttaaaaatttataaggattttttgtagaaaactttttggaaaattcagcgattttttcgcagaaatccgaagaaggacttcgccattttacgttactgtttaccactttttcaggaattcctaaagcggcgagtggcagagtattcttttttaaattagtgaaaatattggctaattgtcctaaatcctcattttcaatataagattcatcagaaagaaaatctggcttcataatatgcgttgtagttgtgagaagtgttggatatccgtggcttgcaaattcctttccaagagtattcataagagaagtttttcccccgcccccgataaaagtgataatttgactgtcagcaagaccaagcagcggagaaaggtcgtggttaaaaaaatatttgttcataataaaaaactccttaaaaaataagaaacttcatattttactattttgtgcaaatatttgaaagtaaatatttgaccgggattctattcaatagtatagttaatgttgtctgattaccgttttgtaattttgataaaaagtaagtttattctgattatagcatagaaaaactagaaacaaaatatttgtaaaattttcagggaaataaatgaaaaatttcggcaacttaattgttaaattttttacgaaaggaaatttaatagaaaatgattaataaggataaaaaaagaggaagaatgcatgtatacatttgaagaatggaaaaagaatttaattattgttcgtggtggaggagatattgcgacaggaacaatttataaattatatcagagtcgttttccggtgttagtacttgaaattgcgaatccaagctgcattcgtcgaaccattagtttttgtgaggcagtttttgataaaaaagttgaggtggaaggagtaacagccaaaagaacagaatccttagaggacgcatttgctatttatggacagggacagattcccgtaatgattgatgaaaatggaagtatgatacaggaagtacagccgcctgttgtggtagatgctattttagcaaaaagaaatcttggaacgaagataacggatgcccctgcagttatcggagttggaccgggattttgtgccggaaaagatgtggacgcagtaattgaaacgcaaagaggtcacaatcttggcagagtaatttatgagggagaagcagctccgaatactggaattcccggaatgataggaggttatgcaaaagaacgtgttattcatgcaccggctacaggaaagttacacattttaagacagataggtgaaatcgtggaagcaggagatatacttgcagatattgaaggaacaccagtaaagacactcataagcggagtgattcgtggtatgattcgcgagggatatgatgtaaaaaaaggattaaaaattgctgatgtagacccgcgtgtgaaggaacaggagaactgctatcatatatcggataaggcaagatgtgtggcgggaggagtattagaagcgatattgcatttgttgaaatagtaatttgccgccctcaaagagcgtctctttgcctgcggcaaatcagaattgttattttactttcattttacggaagctcaatgccagattttactttcctatgttactatagcccggttatgtaataagaagatgaaaaatacaataagatttttatggagggaaatagtaaatgagccaacaggtatatgtgaacagggaattatcctggctgaagtttaatgagagagtattagaagaggccgaaaataagaaagtaccattatgtgaacgactcacatttgcttctatttaccagagtaatttagatgaatttttccgtgtgcgcgttggttctttagttgaccagatgttgcttggaggtaagattcgtgataataaaacaaaaatgacggcaaaggagcagatagaagaggtattacatcaagtaatgaagttaaatcgcagaaaggatgcagtttatgatgcgattatgggtcagcttgaggactatggagtaagactggttgattttcgtaagatttcaaagaaagagagtgagtatcttgagaaatattttttaagtgagattgcaccagttatttcgccgacaattgtaggaaagagacagccatttccatttttaaagaataatgaaatttatgcagttgtagtattgcagacgaaaagtggaaaggaaaagcttggtattattccatgtagtaacacaggatttaagcgtttggttgagctgccaacagcaggaacctatatattggcagaagaattgattttacattatattccagaagtgtttaagcgttataatattaaagcaaagtctttgattcgtgtgacgagaaatgcagatattgacgcagatgcattatatgatgaagaccttgattacagagattttatggcagaattgattaagcgcagaaagaagctggcacctgttcgtttagagcttacaagagagatggatggagaaatcgtagatgttctctgtgattatttggagcttgattctgattatgtatttcaggtacaggcaccgcttgacttgtcctttgtgtttgaaattcaggatacattaagaaagactccggaattattttacgagaaaagagtgccacagaaatcatcacagtttagggacggtgagcctgtttttccacagattagggaaaaagataaattgctttcctatccttatgagagcatgaagccatttcttaatttcttaagagaggcagcaaatgataaagaagttatttctatcaagatgacgttataccgtgttgcaaagcacagtaagattgtggaatatttgattgatgcggcagaaaatggcaaggaagttcttgtgcttgttgagttaaaggcaagatttgacgaggaaaataatattgagtggtccagaagacttgaggatgcaggatgtcgtgtgatttatggtttagatggatataaggtacattcaaagttatgtcttgttacaagaaagtctgaaggacaggtagaatactatacacagattggaacgggtaattataacgaaaagacagcaagattatacacagacctttcccttatgacagctaatgtggagattggtcttgaggcagcaaaggtatttcaggcattatctatggaagaaactgtggataatgtacagcatttacttgttgcgccaagatgccttcagaataaagtattatcaatgattgatgaggaaattgcctgtgcaaaagaggaaaaagaagcgtatatcggtcttaaaatgaattctcttaccgataagaagattattgataagcttattaaagcttctcaggcgggagtaaagattgatatggttattcgtggaatttgctgcctgattccgggagtaaaaggtaagacggaaaatattcaggttcgaagcattgtcggacgttttttagagcattcccgtatttatatttttggaacacaggagcgggaaaaagtttacatagcttctgcagattttatgacaagaaatacattaagacgagtggaagttgcgacgccaatttatgataaagatttaaagatgcaattagaagagatgtttatcacgatgttaagcgataaccaaaaagcgagacaggaggacagccgcggtaattatgaaattgcagaggcacaggagactccattaaattcgcaggaatttttctatgagcaggcatatatgagagttactatttaattcattagatacactacagacgaagccattgcccccaataaggcatatttgtgattttagtcgcggtgtgttgaatgtttgctttatgcgctcacatccaacaattgctccgagaccacaaatatgccttattggggcaatggcttctgtgctgtggctggagaagatgaattaaacagggggatttggggacagaagctgatgtattctgcttaatcgagaatgactgggaatagaggggatgatttgacttgactatattatattggagcaagaagtaagcttcaatttcccttttcaacttttataactttaatttaaatgcaaagcatctgttcacaataatttcagagcaagcagaaaatttctactctctcccccaaatccccacaactactatttaattcaaacaaaatccagccaaagacagcccgagaagagaaccgatatcctatatttgtggcctcggagcaaggtttagatgcgagcgcataaagcgagcatttaaactgccgcgactaaagtcacaaatataggatatcgtatctcttctcgggcgtctgttcttaatgaattaaatagtaacaagaaacattttgttttgaggacatatttaaatagtagaacaaatatggtcttggagacattttatgattatagatatagtaaagggcatcagtgttccctttttagggacgacattgggtgctttttgtgtatttttcttaaaaaatgaacttagtaaaggaatgcagaaagcattaactggatttgcagcaggtgtgatggtggcggcttctatctggagtcttcttcttccggcacttgaacagggggcttcgcttggtatgtggaagttccttccagcagtaattggtttttggattggaattttatttttaatggcaatcgactattttgcaccaccagaatgtattgatgaaaaatgtaaaaataagctgcttctggcagtgactcttcataatattccagaaggtatggcagttggtgttatttatgcaggactgttaagtggggcagagcatatcacggaaatcggagcattttccctcgcattaggaatcgctattcaaaacttcccggaaggagcgattatttctctgccactttgtacagaaggaatgtcaaaaaagagagcctttatttatggagtactttccggggcagtagagccagtggcggcggtgtttactgtctgggcagcaagccttatcgttccgcttctgccatactttttaagttttgcggcaggggcaatgttctatgttgtagtggaagaacttatcccggaaatgtctgctggaaaacacagcaatattggaacgatattattttcctttggatttacactaatgctgacgcttgatgtagcattgggatagttactatttaattcattagatacactacagacgaagccattgcccccaataaggcatatttgtgattttagtcgcggcgtgttgaatgttcgctttatgcgctcacatccaacacttgctccgagaccacaaatatgccttattgggggcaatggcttctgtgctgtggctggagaagatgaattaaacagggggaggggatttggggacagaagctgatgtattctgcttactcgacaatgactggtagcagagggtatgatttgacctgcctatatgtaatagtaaaatgaagaaatcggcattttaaatttgattttataaatattgcggatgataacataataattatatcaatttgcttaaaatctagtatccaatcagtaataatagtttacgaataatcttttagcagcttacaataaaagatacacgaatcaaagtgggataaaaaatatctatctacaatattttgaaagcaagcagaaaacttctaccctttccctcaaatccccacaaccactatttaattcaaacaaaatccagccaaagacagcccgggaagagaaccgataccctatatttgtggcctcggagcaaggtttagatgcgagcgcataaagcgagcatttaaaccgccgcgactaaagtcacaaatatagggtatcggttctctccccgggcgtctgtctcttaatgaattaaatagtaaattatgcttgattttttgactcaaatagcgtactatattggtaaattcatacacggggagcttgcagaagcaggctgagagtaagctaaagtgcttagacccataacctgatttggataatgccaacgtagggatagcgtagatatattcgcatatataccgagattggtgtatatgcgtttttcttttcagagtaaatcattttaaaataaattgctttaagagaaaatctacattgaatctttataaattttcttttattttttatcgtttatttatccatattcagaatatttctcaaatatacttctgagcattttgcaaaacgcacttcaggaagtataggatgatttcagttttttcccgtttatgaaaaataaatagacatgctaaatatatatcagatgtgagatgactccaacctctgtaggtggcgagcaacaatgccggagcattcttgaatgaatatatatgctaaatctatatgtaaagaaagggtaaaaatgttaaagcagtgttttgataacgtaagagaaaagcatccattggtacataatattacgaactatgtaacagtgaatgatgtggcaaatattcttcttgcctgtggcggcagcccgattatggcggacgattctggagaagtggaagatattacttctatttgtcagggattgaatattaacattggtacgctgaataaaaatacgattccgtccatgtttttagcaggaaaaaaggcaaatgtacttggtcatgttgtgctgcttgatccggtaggagccggagcgagtggacttcggacaaagacagcgaatgagctagtgcgggacataaagtttactgttatccgtggaaatatttcagaaatccgaaccctgatggaaggaacgggaaatacaaaaggtgtggatgcagatttggcagatgcggttacagaggagaatcttgatgagacgattgggaagctgaaagcattttctgaagcgacaggaagtgtgattgctgtaacgggagccattgatttagttgctgattctgaaaaatgttatgttatccgcaacggaaaaccagagctgggagcaatcaccggaactggatgccagctttctggaatgatgacggctttcctttgtgcaaacgcagagcagcctttggaggcagcagcggcggcagtttgtgcgatgggaattgccggagagattggatttgaacatttaaaagaaggtgagggaaattccacttaccgtaatcggataattgatgctatttaccatatggatggaaatacattggaggaaagagcaaagtatgagctgcgttaacagagaacaattaagaaaagatttacttttatatgcagtaaccgaccgttcctggcttggaaatgaaacactttacgagcaggtggaaaaggcattaaaaggaggagcgacttttatacagcttcgggaaaaggaactcgatgaggaacatttcatggaagaagcggtggctctcaaagaattgtgccataactatcatgttccatttgttatcaatgataatgtcagaatcgcaaaagatatggatgcggatggagttcacgttggacaaagtgatatggaagccgatgacgtgagaaagattcttggtgaagacaagattcttggcgtatctgcccagacagtagagcaggcagtattagctgaaaaaatgggggcggattatcttggcgtgggagccgtattttccacttccacgaaaaaagatgcggcagatgtcagcaaggaaacattaaaagcaatctgcgaggcagtaaatattccagtgattgcaattggtggaatcggggcagataacattttatctttacagggaagtggtatttgcggtatcgctgtggttagtgctatttttgcggcaaaagatattgaagctgctacaaaagttttaaaagacagaacagaaaaaatgctgaaataatttttcggtagttagtggaaaagacaataaaaggagaaaggcatcgtgataaaaggagcaatctttgatattgatggaactttacttgattccatgcccatctgggaaaatgcaggagcgagatatcttgctactcttggcattaaggcaaagccagatttaaaagaacggctggatgctttatctttgccagaaggagccatctatatgcaaaaagagtatggcctttcggtatcagcagaagacattttagaaggagtcaatcaggttgtaaaagatttttactataaagaagcggtcatgaagccgggagcctatgccttagtaaaacgtctgaaagaaaatggtgtgaagttaattatagccacagcgacagataaggagatggcaaaggcggcgcttattcgtaacggcatatggcaggactttacgggaatgattacctgcgaggaagccggagccggaaagacaagcccgaaggtatttgagcttgcaaggcaaaagctaggcactaaaaaagaggaaacatgggtatttgaagattctttatatgcggtgaaaactgctactgaagctggatttccagtatgcagtatctacgatacctacagtgtgggaaatgcgaaagaaatccagaaactttctaatatttatgtgagagatttttcggagataggtgattattctttttcaaatatgaaaacagttcttacaattgcaggcagtgattcgagcggaggagcaggtattcaagcggatatcaagactttaactgttcataaagtatatgccatgacttgtatcaccgcacttaccgcacaaaatacagtcggaattaccgggattatgccagtaccagcagaattttttaaaaaacagatggaaagcattttcacagatataaagccagatgcggtgaaaattggaatgattgcttcaaaggaacaggcagagattatcgcagaatacctggaaaaatattctatcaaaaatgtagtggcagacccggtgatgatttcgacaagcggtacggttttagtagaagaaacaacgagaaagatattatatgagaaattatatccaaaagtttccctgctaaccccgaacattccagaaaccgaatttttatccgggataaaaattaccgataaaaaaacaagggaagaagcagcaaaagtcattgcagacaggtggaattgtgcggtcttaagtaagggcggtcacagcgaagaaaatgcggacgatttgctttatgagagttttttgcaggaagaaaaaaaagaaaaagccgtttggtttccagaagaaagaattgataatccaaacacacacggaaccggctgtacactttcaagtgcggtagcggcaaatctggcaaagggatttcctgtagaagaatccgtaaaaaaggcaaaagtatacatcagcggagcaattagagcaatgctgaatcttggacagggaaatggcccgctaaatcatatgtgggatttgtaaacatagtaacagacaagtgtcaatgtatataaagtaatgaaataaacagattagttaagctttataaaaatggcattataaatagtatttacaaaattggaggtaacaaaagatgagaaattacacaacacagatggatgcagcaagaaaaaatattattactccagaaatggaaaaggttgcagcaaaagaacgaatgacaccagaagaaatcagagcattagtagcagaaggaaaagttgctatctgcgcgaacaaaaatcataaatgcttagacccacagggtgtcggctctatgttaaaaacaaagattaatgtaaatcttggtgtatcaaaagactgtaaagattatgatatagaaatgaaaaaagtaatggaagcagtaaacatgggagcagatgccatcatggatttatcttcccacggaaatacagaaccgttccgtaaaaaactgacttccgaatgtcctgtaatgattggaacagtaccaatctatgattctgtaattcactatcagagagacttagatactcttaccgcaaaagactttattgatgtagtacgtcttcacgcagaaaatggtgtagacttcgtaacattacactgtggaattacaagaaagacaatcgaccagattaaaaagcataaaagaaaaatgaacatcgtatcccgtggaggttcccttgtatttgcatggatgacaatgacaggagaagaaaaccctttctatgaatatttcgatgaaattcttgatatctgtcaggaatacgatgtaacaatctccctcggagatgcctgccgtccaggctgtcttgccgatggttccgatgtatgtcaaattgaagaattagttcgtcttggagaacttaccaaacgtgcgtgggagaaaaatgtacaggttatggtagaaggaccgggacatatgccaatggatcagattgctgcaaacatgaagttacagtccaccatttgttctggagcaccattctatgtacttggaccaatcgtaacagatattgcaccaggttatgaccatattgtatccgctatcggtggagcaatcgctgctcaaaatggtgctgcattcctctgctatgttacaccagcagaacaccttgcacttccaaatcttgaagacgtaaaacagggaatcatggcatcaaaaattgcggcacatgcagccgatatcgcaaaaggtgtccgtggtgcaagagagatagatgataagatggcagatgcccgccgtgttttagattgggaagcacagtgggaatgtgcaatggatccggaaacagccaaagcaatccgcgatgacagaaaaccagaacatgaggatacttgctctatgtgtggaaagttctgtgcggtaagaagcatgaataaggcattggctggagaacatattgatattttgtaaatagtaatttgtgaagataagaggagacgctcccaaagaaagaagctatcctatatttgtgactctgtcactgtgggttgaatgtttgctgaatggctcacattcaatcctcactctagagcgtgtttgaaaaatcattcctgcaatctgcacgccccaatttgcggtatattttgccttcattcagttgacgtagcccgctacgccgccctcattcaggcgaaatctcccacaaattgtaacgcacatcttgcagaaagcattttttagacacgctctaagaccacaatataggatatcttctttctttgggagctgttttttgctgaactgaaattattattttacaagttcagtagtagtttttgcagataatctgtatattttgcctttcccactgtttccgaagccaatatagaaactttcccaatttttttgttattatatgaatactccagtctgccaattacttgatttttcttaattggagcagagagatttttctggaataccacttttttctgaatgttattttggttgatttccgaagtaaaaacataggagaagtttttcttatatttgcaggaaatgaattcttttgtgccattatgtacggggacggtggagagtgcgggaggctgtttatcggtgtaaatcttgcagagagagaagccgtaatcaagtaaagaggcacagtcttttacccgctcttttgagctttggcatgccataacgacagcgataagggaaatgtgattgcgttctgcggtggcgcttaaacaaaagccggctttggaggtacttccggtttttagaccggttgcgccctgataatgccggagtaatttattagtattagaaagtccaaactcagatttccctcgttttgttacatgtgtaatattttccatccagattgttgtataatggaaaatgtctggatgattcgtaatcagttctcttgacattaaggcgatatcccttgcacttgtgtaatgtccgtccgcatctaatccgcagcaatttacaaaatgtgtatgcttcatgccaagaacctgtgctttctcgttcattttggcgacaaaagcatcttcactaccactgatgtgttctgccatagccacacatgtagcgtataggggtagtagacttttaaaaatcaatctttatatggtttatggttacaaagggatgcttcaaaaccgatgagaagggatcctggctctgcgtaataactgcaaagggctcttgttttttgaatcgttccattaaaaattccaaatgtattttcaatcaatttttttaattctaatgcaccggcttcattgttgttatgagcaatgatgatttttccatctgtataaccacattctttaagatgatcaattagtttttttaatgctcttttttcacctctgcatttgtcaagcggcaataaagttccttcatcacttgccttcccaacgactctgactcctaataaaccgattccggctgcaattaccggacttatccgtccgttctttgcaaaattgtttaaagatgccagagaaaaatacaggtgtgttttatctttatattcgagaagagttttataaatatcatctggagcaaaaccagcttttatgagttctgctattttttcaataaaaagtgcgatttccggtcctgtagataaagaatctaaaacatatacctttctgccggtatgattctgttcatagatgtccttagcgataacagcactgttatatgtaccggacagggaacttgtaatggtgatgcaaaagacaacatcggcatcgccaaacgcattctcccattcgtgaggacttgggcttgatgtcgatgtctttcctttataagaagaaagattctcctgcatagctgtaagatcaatcttatcatcatctatataatcgttctcacctacgattatatgaagtggaacaaccccgaagtctatatcaggtaaagctaaaagatttgcagatgaatctgcaacgattttcattttcatatgtaacctccgtgaatagttttaaatacttttatatcggtttttaaaaaacttatcaaaaagtatagtaaaccatacatatgtgtttgtcaaggtattaaataactttattgcggttttttaatagctgatatataatgatgttcagaattatgggagcagcgttagagcatttttcaaacacgctctagctgcggagtaattcgtggcatcaagttagagacaaagtaagaaagaaggaatgtattatgagattttcagccagagactacagaatgccaagatataaagaaattccaaatgtaggactttatcttgagcagacagtaaagtatatcaatgaatgtttagcaccaatagagatttcgattacaccatctatgttaagtaattatgtaaagaaggggtatattgaccgtcctataaaaaaacagtattatgcggatcaaatagcatatactatttatattgtaattataaagcaggttctttccatggataatatagcatccctttttgttttacaaaaagcaacctatactttaccggttgcttatgattatttctgttcagaattggaaaagacactcgtagctatatttgaaaataaagaagagccaatgaaagatatgggcgatattccgttcgaaaaaaagatgcttcatagtgtaattgtagcggtatcgcatatcatttatttaaatgactgttttaaaaacaatttacaggacaatgcttcccattctataaaataagtgaaatgagcatatgtcaactacgttattgacatatgttcataaatattgtagtataaagaaaagattgtgaaaggagtatcctatgccaagaccgataaagtgcagaaaagtctgccattttccagatatattggaatttcgaccatccaataaaaatggaagaagaggggaggaagatgaaaaagaggtgattcttctgacagtagatgaatatgaaacgattcgtcttatagataaagaaggatacagccaggaacagtgtgcaggctttatgcagattgcaagaacgactgttcaaagaatctatgagattgccagaaagaaagtggcagatgcaatcatagatggacatcctcttcgaattgaagggggagattttcgaatctgcgatggtaaaagtagtaaatgtggtctgggtggatgctacaaacaagaattttatcaaaagtatgcaacagaaaaaggagaaggtataatgagagtagcagtaacatatgagaacggacagatttttcagcattttggacatacagcagaatttaaagtttatgatgtacaggatggaaaagtaatccattctgaagttgtcgatacgaatggaagcgggcatggcgcattagcaggtgttttaaatgcattgaaggcagatgttcttatttgtggtggaatcggaggaggagcgcagatggctttatcagcggcagggattaagctctatggaggcgtttccggtgatgcagatgcggctgtggaagcttttatgaacggaacgttagattataatcctgatgtaaagtgcagtcatcatgatcatgatcatggagagggacatacctgtggcgagcatggatgtggaagccacagctgccattaattgttaataaagaatagattgagaaaaaaggtaagcagaataatgcttatctttttttgtccacagatttaagagagaaaattcaagtcgagccgctgcgagacttggcgcgtgattctggtcagtataagctgacatataaaaatcaaggcttgacaaaaaggaagcagaactatataatcataatcgttctaaatagaacattaataaggagatataacaaggagtaaaaatatgtttttttgggatcagcataaaacaatcactagctgttatgaactatttacgagaaaagtatgtgacaggtatcagctaacgcaaatggaatatgatatacttatgtttttacataataatccgaagcataatacggcagcagacatcgtaaagattcgtaaatcaacgaaatctcatgtatctacttctctgaaagcattagagaataaaggcctgattgaaagaattcagagcgcccggaataaaaagcatattgagattgttatattaaataaggcagagtctattatcgaagatggaatgaaagcacagaaagaattcgctaaaaatgttttagatggattaaccgaagaagaaaagtatatgtgcatggcggtatttaataaaatttgtgctaatgcagatgcatacttaaaaaaatatgcggagggagagaatgaaaaatcatttttgttataaccaattaatgaaaaaggagaagtaagaatgagagaagaaaaataccagccaaagatgccggatattatggaagcgatatttgatgccggatatttgatatttgatttagtagcagcaattttatttttcacctatgcaaaaggaaatacattatttattctttatggaatattaacattgactctttgcggtggagatgcatttcatttagtacctagaatcataagagctgcacgtggaacgaatgatagaataaagaaacagcttgggattggattacagatatcctcaatcacaatgactgtattttatattattttaatgtatgtttggaaggatactttcccggattttaatatacctgctgcagtgaaagcaatggtatggatttctgcgattattagaattgctgtctgtcttcttccacagaataactggtgtacagaggatggaaatctcaagttatcgattatcaggaatgctgtttttgctgttactggtataggagtcattattctgtatgcgatatctggaaatgcaaatggataccatatgacaagaatggtcgcagcgattattatttcttttggctgttaccttcctgtaacattatttagcaaaacaaaaccaaaagttggcttgctgatgattccaaagacatgtgcgtatatgtggattattgcaatgggacttcaactgttgttttgataaattaaggaaagtatctccaatcctctaatttaagaatgcgagacattttgaatgaaatctatcctgacttatttcaaaataatattattataaaattaactatttaagccgcaatagcgattatatttgtaattaaaaagaaggaaaatactgtaaagaagagtatcagaatactaaagttctggtactctttttgcgtatttatggaagtgaaaataaatttaattttaatagatggacaaaatatatttttctggaaagggtgatatacatagtagaaaaaaacgagggcattatgagcaaaaagaaaagcagagttattaaagtaaatgtgatttatggtgataaaaatttgaaagattgtatggagcaggtaatccagaaacacgaacggagttttgaccttttgaccctgatatcataatattaatgaggtgaaagatgaacaataaagcagtattatatctaagattatcaaaagaagacagaaataaagtgaataaaggggatgatagcgaaagtattattaatcagcgtattatgttaagtgattatgcaatgcggcataattttcaggttgttaaaatatattccgatgatgatgagagtggactatatgaagacagaccgggattttctcaaatgatgcaggatgcagagagggggctttttgatattattattgcgaaaagccagtcaagatttacccgaaatctggaacattcagaaaaatatttacatcacaaactgccattatggggtgttcgatttattggtgttgtagatggcgtggatacgatggatgaaaataataagatgaccagacaggtgaagggacttactaatgaatggtattgtgagacattgtctaagaatgtaagaagcgtattcctctccaaaatgaatcagggtaaatttgtaggttcttcatgtccttatggatatatgagagattcagaagaccataatcatttaataatagatgaatatgcagcaaatattgtgagaaagattttccgattatatttagagggaaatggaaaagctcatatcgcttctatattatcatcagaaaatattttgattccgtctttatataaaacgcgagttctacagcaaaattactataacagcaaattaaaagatacaacaaagacatggtgttatcagacggtacatatgattctaaataaccagacatatttaggtaaaatggtacagcataaggatataaaaatttcttataaggataagaaaaagagacgtttgccgaaagaacagtggatagttgtagataatactcatgaaccgattatagatcaggaaacctttgatagagttcaggcaatacagaaaataaaaagaaaatctgtaaatacagagtatagcgataatatatttgcaggtattttattttgtgccgattgtaaacatgctatgaatagagcttatgccaaagaaaataaaaagggcagtatcgggtatatttgcaagatatataaaacgatggggaaaaagcactgtccaagtcatatgattaaaaatgaggagctggaagaagcggttttatcttctataaagaatgaagcaagaaagatacttacagaggatgatattagcgatttggataaagtccagaagatagatagccgggaacaattttataaaaagcaaatacagatagtagatgcagaattggaaaaataccaaaagtttaaaaagagagcgttcacaggctatatggaagagatgattacaccacaggaatatcgttcctatgttgcagaatatgaagaggaaatatccaaattagaaaggcagaaagaagaaattcttacaaagttagcggatgagaattctcttcaaaatcagcatgatgaatgggtagaagcttttaaggattatattaatattgagaagcttacaagagatgtggttattgaattgatagaaaaaatagaagttcatgaagatggtggactggatatttattacagattccgtaatccatttcaggtagcaaattaattcctactatgcgaatacgccacacatgcatcgttagcggaggagacagcaatacattttatcatagtgtctacgctctgggtttcacctggttctaaaaatacctgggagcctcccatagatgcagcgtgttcgctgacggtaaccgtatcatttaaggtaatctgcttttttgaaagagcttcaaagataagtaagagagtcataacttttgtgacgcttgcaggcggtttttctttgtctgcatctttttcataaagaattgtaccagtagtggcttccattaaaatggcattaggtgcagcggattgaaatccagtgtttgcagaagatgcactggaactttcagagttagtctggtaagaaacattagaagtactatcagtggcagcttgaacagaaatattattagaagtagtaatattttttaaacgattagaaagctcgttgattcctgaattgtcagaaagtggatttaaagagttttccatagaattaccagaagaagccaaagaaactattttcacaggaaaaagaatagtccccgtcagaaaacttgttatcagaaaaaatgcaaaggaataaaagaattttcgtgtaatttttctggaaaaatatttttgcatatgatactccaaataagaattagtacattttatggccagtgcctaaaaatatgcatttccttgttgctaatcttaagaaaattgcttaaaatagaagtaaatatctgggcaaaataaaatgatgaggggatacgattatgaatttacatgaattttatattggaaaagcgtttgatgcgtatgaatattttggagcacacttgacaaagaacggtgtgttatttcgagtttatgcaccgaatgcggaaaagattgaggtgatcggagagtttaatgactgggatggtatagaagatgagatgattcaggatgcacagagcggtgtgtttgaatgtgtacaaaaggatgcgaagccgggaatgatgtacaagtaccgtatttatcagccggatggaattgttatggatcgttttgacccgtacagttttggttcacaggtacgaccagatacagcatcagttatcgtagatttggaagactatcatttttcagatgaagcgtggatgaagaagagaagtaagaattatgatcttccggtaaatatttacgaggtgcatgccggttcctggcgaaagaatgaggcagacgaggagaatggctggtatcattatcaggagttaggaaagcagcttattccatatgttaaagaaatgggatatacacatgtagagttcctgccgctaactgagcatccggcagactgttcctggggatatcaggcaagcggatatttctgtccgacttcccgttatggaacagcaaaggaattaatggagatggtagaccttttccataaagaaggaattggtgttatcatggactttgttccggtacattttattgcggatacttatgcgctgaataagtttgatggaacggctctttatgaatatgcggacgatgataagggttatagtgagtggggaacctgtaattttaactattaccgtggtgaagtgcgaagctttttacagtcctccgcgaatttctggatggagaagttccactttgacggcatccgtatggatgcgattagtaatgctatttactggcagggagattcttcaaagggaattaatgaaggcgcgcttgattttatcaaatgcatgaattctggtttgcaaaagttacatccttctgttatgcttattgcggaagattctacgaacttcccgaaagtaactgcaccggtagagtatgacggcctgggatttgactataagtgggatatggggtggatgaatgatacgttagattattttagaattcatccatatgacagaaagttccattatcataagctgtcattttctatgatgtatttttataatgaacattatctgttaccattttctcatgatgaggtggtacacggaaaggcaaccattttgcagaaaatgtggggcgagtatgacttaaagttccagcaggcaaagactctttacacttacatgtacactcatcctggaaagaagcttaatttcatgggtaatgagattggtcagttcagagagtgggatgaggaaaaagaatgtgactggatgctcttagactatccaaagcatcaggatttccaccgttttatgaaggatttaaatcatctttatatcagtgaaccagcatttttcaatggagattataattctgcgaacttccgatggattgaggtggaagcggttgaggaaagagtgtacatttacgagagaatgtgcggagagaatcatttcatcgttgtactgaacatgagtgatgcacagtataatgactttgaatttggttatgatcattatgcagttcttcatgaagtattatctggtgagcgaaaagagtatggtggatattttgagggaccaaaggaagacatcgtggcaaaaacaacgggctataagtggtggaagagaaagtttaagattacgattccggcacttgccgctatcatttataaagtagaatttcttccagagccaaaggagatacctcttcctatgttagatgaggcatcaatagatattgaccgaaagagacttagagcagagcatgaaaattgatattaaactggatgtatttgaaggtcctctggaccttcttctacatttaatagagaaaaataaagtaagtatatacgacattccaatcgtggaaatcacaaaccagtacatggaatacatccgtgagatggaaaaaacctattcgatggaatcaatgagtgagttcctcgttatggcagcgaccttattaaagataaagtcaaaaatgctgcttccacagccggaaaaagaggaggaagaagatccaagagaagaattagtccgccgtcttaccgaatacaaaatgtacaaatatgcggcagaagaattaaaagacttaagtgtagatgcccagaaagtattctttaaaccggaaactgtaccagaagaaatcaagtactacgaggagccaatccgcccggaagaaattgttggggacatcactttagaaaagttaaaccagatattccgcatggtcatgcgccggaaaaaggacagagaagatccggtgcggagccatttcggaaagattcagaaagaaaaatataaagtagaagaccgtatggatgacatacgccgtcagattcgcggactgaaaaaaataaatttccgaacccttcttgatattcagcccgtcaaggaaatggtaatcgtaactttccttgcggtacttgaactgatgaaggtaggagagataaaagtaagtcaggagcataactttgcggagatatacttagattcctgtgaatagggggtactgaagaattggaaaagaggtattatgaaagataaagagagaataaagggaattattgaggcgattctttttacgatgggagagtcagttgcaatttctcgattatcagaagttcttgacatagaagaagatacattaaaagaactattagaggaaatgaaaggcgattatgccggaaaggatagaggaatctgcctgattgagttagatggggcgtaccagatatgtacgaagattgagacttatgagtatgtcaaaaagttagtaagtcagccgaagaagcgttctttaacagacgttatgttagagacactttctatcgttgcctataaacagcctgtaactaaacaggaaatcgaggcgattcgaggggtaaaaagtgacttcgcggtaaataaactcctcgaataccgcctgataaaagaacttggcagactcgatacaataggacatccaattgtattcggaacgacagaagaatttttacgctgctttggcgtatcctctattgaggaacttccggatattgatgaagtacagaaacagaactttatggaagaagcaatggaggaggttgcggcttcaataacagtataacgcaacaagaatgccggggcattcttgaaatcaattattttcattctgaatttctgccagagcctttttaaactgaaatgaaaataaaactgatgtaaaaagtaccgcaataatatccgcaatcggttccgccatatacactcctgtagttggattggataccacatgaggcataatataaataagcggaagcagcaatacaaatttacgaacgacagcaacaacaatagagtttactgcttttccaagtgaagtaaatgtcatctggcaggcaatctgaatgccgaacaggaagagacctcccagatagattctaagcattggagcagtaaagttgataagactcgcatctgcggtaaaaatacttacgaatactcttggaataagctgtacagcagcccaaagtaatgcagaatagctcagacaggtcatcaggagcaaacggaaagttttctttacacgattcgtattttttgctccgtaattatagctggaaatcggttgcgctccctgggcgattccctgaagcggcagcatagcaaattgcattacactggtcaaaatcgtcatggctccgacagcaatatctccgccataacgaagcagagaggaattaaagcaaaccgttacaatactttcacttgcctgcataataaaagcagccagtccaagagtgacacatggaacagaaacttttggttccagacgcatatatttctttctaagatgaagatgtgttttttcaccgcaaaggaaagagacaacccaaatcgtagaaattgcctgtgaaatcaccgttgccagagccgccccttttacacccatatgaaaagcaaaaataaatacagggtctaaagtaatattacaaatggcaccaataagaacagaaaccatagaaatagtagtgaatccctgtgcagtaataaaagcgttcataccaagtgttaactgcacaaacaaggttccaaacgcatagatatgcatatagtctgtggcatagctgattgtattttcactggcaccgaatgcgagcaataaatctttactccaaatcagtaaaatagcagttaaaataagagaaataacaatctggagaagaaaacagtttccaagtatattttctgccgattcattatcctgctttcccatataaatagaagctcttggagcaccaccggagctgactaatgcggcaaaagcagtaacgatcataatgattggcatacagactcccacaccagtaagagccagactgccatcactggggatatgcccgatatagattcggtctacaatgttgtagagcatattgatgagctgcgcgattacggttggaatcgacagcttaagaagaagctttccgatgggttcggcagctaaaaagtttttgttgtcttgcataaatatatagtctccttttataagaataggttcgcacattttattgtaagcatttaaagtgtcgtgaaaaaagctacgaatgtggctggggcatatgattcattcttctccttcctaaatggtatttttttgaactgtattaaataatatgatgaatgatagggaaagtcaagattctccctttttattgttataatatgatgaatgatagggaaagtcaagattctccctttttattgttataatatgatgaatgataaggaaaataaaaataatgagaaatggatagtactaacaaataatattgtgacttccattttttttactttgaatgatttttcaaacacactctaggcgttaaagcggtaatgtttttcttgtgtatagtggaatatgggagtataataataatattaatatttttgtataagtttaaaagttttaataggataatcggcaaaccagatgaaagtctgggacgcaaagctacagggtctttaaaatggcagccagctgcatgaaatgagatgcactgtctgtttggcagtgttttttatgatattatttcatagacgtaactataataattttataaagaagagagaaaaaatatgaaaattaaaaaactacaaagtgtatgtctcattttggcatgtgtagcagtaacaggacttataggatgtggggaaacagataagagacctgtataaagagggctatgatgcagtcggtacaggaaataattacccttatgtattggtaagtctagtagaactggaatatgaagtatcttcacaattcttcctttgagaaaacaaaggcggaactggaagaaaaaggatgcagttattctaatgcagttctgattggtattacgtcattaatcagatatgatgccggtgataaaggtaaggtaatagagtatgcggataaaattgatacgtcatcacagcatctgttaggtattattaatgatgttttggatatatgaatgcacatgtctcaaaaccagttgagatgaaggtactggaaaagacgattagaagcataaaatccagcgggggggtaccgaaatgcagggcattgaacagtgacaaatggaaagtaaccagacataaaaaaatcgaaaaggatagttaggaatagacagaaaatgaaaggaaaaagagtgattgcaggcattctgcttgcaggaattttagcagtcaccctggcagggtgcaaaaacacagataacacgaaaaaagaaaccgaaaagcctgttattaccctcggtagcgacaactatccaccatacaattatctgaatgaggatggtgaaccgacaggaatcgatgtagaactggccacagaagcgttcaaaagaatgggatatcaggtggatgttgtccagattaactgggagaagaaaaaagaacttgtggagagaggagagattgactgtatcatgggctgcttttccatggaaggacgtcttgatgattaccgctgggcaggaccatacatagcaagccgtcaggtagttgccgtaaataagagcagtgacatctataaactgagtgatctggaaggaaagaatcttgccgtccagtccacaaccaaaccggaaggtatctttctgaagcggacggatgagagaatcccaaaactggggaatctgatcagccttggccacagagaactgatctatacgtttctgggaaaaggatatgtagatgcagttgccgcacatgaagaatctgttgtccagtatatgaaagattatgatgcaagcttccgtattctggaagaacctctgatgctcaccggaataggtgttgcttttgcaaaaaatgatgacagaggaatctgtgagcagatggaacagacactggaagaaatgcgtcaggatggcacatccctgaaaattgttgaaaaatatctggatgatccggaaaagtatctggaggtggatgatcttggatattaagagaaagaaaaaagaaaaacgaatccagctgctcggtggcctgattggaatctgtgtggctgtagtctctctgttttatttctttcatgtagaaaaagcggaggcagagaaaagaatggtggagattgtaaactatgtcaaagtgcagtgctcaacctacactcattacaatgaatcatcggaatccaaaagtcttctccgtgccattgaaagtgccagacagatgagtacaaatattaacatggaaacagaaaacggcaggcagctaagccgggatttcctgaaagaaaatctgcagactctctgggtgaatggcatcattgtactggatacagaaggaaagatagattgtgaatacagtacggatgaatctctggcaaatgagattacagagtatctgcaaaaagaaattatcatggattttgtcggatatgaagaaagatcgtattcagaacggattaacaggaaagacggatcacatattgacattgcagcctgtgccagaaaagatgcacagggtatcgttgctgtttattattatacacctccgaaatttgccaggaactatactctgacgatacagagtcttttaaacggctatagcacccagaaggatggaacgattattgttgcagacgagggaatcattgttgccagcaatgatgagagtttgttggggcagaatacggctgacaacgaagttgttaaggcaatgaagaggcatacagacagtcagcacatttatcatttgaagaatgaaggaaccggatgctacggaatcatgctgaagcagcgtgattattatatctatgcgtatctttcggatacagaagtgttccataaccttccattaaatgtgataagcgttatttttctttatttcctgatgtttagtatattctggttttggacatacagaaccaatcagtcacatcagaaacaggaacaggaaaaagatgaaaaatataaaacagaacttctgattgctgcaaaaaaggcagaagcagccaatgaggcaaaaacagagtttctacagcgaatgagccatgatatccggactccgatcaatggaatctgcggcatggtaaatatggcagatcattatgcagatgatatggagaagcagaaggaatacaggacaaaggtgaaagaggcatccaatctgctgctggaactggtaaatgatgttctggatatgagtaagcttgagtcaggtgaaatcgttctggaagagattccatttaatctgagcagtatttacagggaagtatttgttgtaatcgagcaggtggctgcagaacagaatctccagattgtgtgggagaaaaaagaaatcacacaccgtgatcttattggaagtccaaggtatgtgaaacgtgtgatgatgaatattctgtccaatgcgatgaaatataacagagaaaacggacatatctatatcagctgcattgaaattccatccggacagccagaaacgacgacaatggaatttgtctgccgggataccggaatcggaatggcagaagagttccaaaaacatatttttgaaccatttgcacaggaacatgcaggaagccgcacaagattttccggaacaggtctgggaatgccgatttcaaagaaactgattgagaaaatgggtggaacgattacctttgaaagcgcagaaggcatagggacgacatttgtgatccgggttccatttaaaatagatttggatgtggatatacgtgaagaacaggcggatgtatccgaaaaatctataaaggggctgcatattcttctggcggaagataatgagctgaatatggaaatcgctgaatttgtgcttcagaatgaaggtgctgaggtgtccaaagcatggaatggcgaggaaactgttgagctattcagaaaaagtgaatctggtgaatttgatgctattcttatggatattatgatgccagtcatgaatggatatgaagccacaaagatgattaggtctctggacagggaggatgcaaaggtgattccgattattgcgatgacagcaaatgcattcacggaggacaggctaagagcaaaagaagcaggaatgaatgaacatatcgcaaaaccttttgatgcaaaactattggtaaagataattcataaattggtgcattagagcatgtttgaaaaatagtctcagaaggggattcgtaatgagaaagaaaaaatggaacagagttttagctgtacttttaatgatggtgatgagtatatcacttctgtcaggatgtggcagcaaaagtgcggaaaaagaagatgcagaaacaattactgtgtatttatggagcacaaacctctatgaaaaatatgcaccatacattcaggaacagctcccggatatcaatgttgaatttgtcgtagggaataatgatctggatttctacaaatttctgaatgaaaatggtggattgccggatattataacctgctgtcgtttctcactgcatgacgcgagtcccctgaaagacaatctgatggatctttctacaaccaatgttgctggtgctgtctatgatacctacctcagcaattttatgaatgaggatggaagcgtaaactggcttccggtgtgtgcggatgcacatggttttgtagtgaacaaagacctttttgaaaagtatgatatccctcttccaacagattatgaaagttttgtctctgcctgccaggcatttgacaaagtgggaattcgtggatttacagcagactattattatgattatacctgtatggaaacactgcagggtctgtcagcatcagaactgtcttccgtggacggacgaaagtggcgtactacctacagtgacccggataatacaaagagagaaggcctggacaatacagtctggccaaaggcttttgggcgcatggagcagttcattcaggataccgggctgagccaggatgatctggatatgaattatgatgatatcgttgagatgtatcaaagtggcaagcttgccatgtactttggcacctctgctggtgtaaaaatgtttcaggatcagggcattaacacaacctttcttccattctttcaggaaaacggtgaaaaatggattatgactacgccatatttccaggtggctttaaatagcaatctgacaaaggatgagacacgtcgaaagaaagcaatgaaggtactggacacaatgctttcagcggatgcgcagaatagaatcgtttatgatggacaggatctgttaagctacagtcaggatgtagatctccagcttacggaatatctgaaggatgtgaaacctgtgatcgaagaaaaccatatgtatatccgcatagcgtcaaatgactttttctctgtttctaaggatgtggtttcgaagatgatatcaggagaatacgatgcagggcaggcctatgagtcatttaattctcagcttcttgaggaggactcctcttctgaggatatcgtgctggattcacagaaatcctattccaatcgttttcacagcagtggagggaatgcagcatattctgttatggcaaacactctgcgcggtatttatgggtcagatgtgctgatcgcaaccggaaacagctttacgggaaacgtgctgaaagccggctatactgaaaaaatggcgggcgatatgatcatgccgaacgaactttcagcttacagtagcaaaatgagcggagccgaactgaaagaggcagttaaaaactttgtagaaggctatgagggtggatttactccgtttaaccgaggctctctgcctgtgctcagtggtatttctgtagaagtcaaagaaacagatgatgattatacattgagcaaagttacaaaggacggaaaacaaattcaggataatgatactttcacggtaatctgtcttgcgataccaaaacacatggaggcttatccggcagatgataatattgtgtttgatggagggaatacctctgtggatgatacatggataggatatatttcagatggtgatgccgttcttgcagagcctgaagattacatgactttgaggtgagaaggatgggcattaagaatcataatacaaaaagagagaagactgtcatgagaaaacggttaaggatagctgtctttattgcagtttctcttggaattgtgttgatagttttccgatattttggatttgtatcgaaaactatttatgaggaaagtgtttctcatctgacggaagtttttcatcagtctgataatatgctgagggaactgacagataagaatctgaactatcttcatatgtggggtgagaatctgcaggatatttccaacgaagatgaaattcggaattatataaagaaagcgcaggaagatgccggctttttagacttcttttttctgtcagctgacgggaactataagatggcaacaggggaaaccggttaccttggattacaggaaaatattgaagatgagatccggcagggaaatgatgtgatagcgaatgcagcggttcccggaaaatcccagctgcttgtttttgccacagctaaggctcatggaatttatcatggatttgaatatgatgccattgccattgcttatgaaaactctgatatcgtagatgtactggatatttctgcttttgatggaaatgcccagagttttgttgttcatcctgatggccgtgttgtggttgatcattcttctgaggcatggggaacgtgtataatttcttcggtgttctgagagagcattctgatatgtccgaaaaagaaattaatgaactttcagagaagtttaaagcaagacgtaccgatgcaatgctgctaaatctggatggaagaaactattatctggtctatgaaaaatcagatattcaggactggatgtttttgggacttgtccaggcggatatcgtcaatgccagtatgaacagtctgcagcgtagtacgatacttcttgttggtgcggtcgtgctctgtattgccgctttacttattagttttattattcaaaaaggcagaataaacctcaggaaaaaggatacggagattctgtacagggacgagctgtttcaaaaactttcaatgaatgtagatgacgtctttctgatgctggatgcaaaaacatatcaggcagattacgtcagcccaaatgcggaaaagctgttgggtattacggtagaacagattcgtaaagatatttgtattctgggaaaactacatccagaggaacaggaagattcggagaaaaattatatggaggaaatccaggttcatgagcagagggaatgggattttgaatatgttcatctgaagacaggggaaaaacgctggttccataatattgtaatgggcagtgaggtaaacggaaaaaggaaatatatcctagttatgtcggatcgtacctctgactggaaaatgaaccaggcactctctgaggcggtacatgcggcggagacagcaaaccaggcaaagagtactttcctttctaatatgtctcacgatatccggacaccaatgaatgcgattatcggttttaccacactggctgtaagtaatattgataatcaggaaagagtccaggattatctgggtaagattctttcctccagtaaccatctgctctcattgatcaatgatatactggatatgagccggattgagagtggaaagatacatctggaagagacagaggtcagtctgtcggatgtgcttcatgatctgaagacgatcatcagtgggcaaatccatgcgaagcagctggaactttatatggatgtcatggatgttacaaatgaagatgtttactgtgacaagactcggctgaaccaggtgctgctgaatcttttgtctaatgcggttaagtttacacctgcaggaggaaccgtttctgtccggctgaaacagtatccgaaggcagtaaaaggcagtaagctgtatgagatccgggtaaaggataccggaatcggtatgagtcaggaattcgtgcagaaaattttttctccttttgagagggagaggacttccactgtgagcagaacccagggcacagggcttggcatggcaatcaccaagaatattgtggatatgatgggcggaactattgaggttcagacagaacagggcaaaggtaccgaatttattgtctgtctgccattacggattcagtctgagtgtcaacgtatagagaaaatcgcagaactggaagggcttaaggcactggttgtagatgatgactttaatacctgtgacagtgtgacaaaaatgcttgtaagggtcggaatgcgttcggaatggacactttctggcaaggaagctattctccgtgcacggcagtctatggaactgggagatgcgttccacgcttatatcattgactggcgtctgccagatatgaatggtattgaagtcacccgtcagatccgcagccttggtgatgatacaccgatcattatcctgaccgcatatgattggtcagatatcgaggcagaagccagagcagcaggggtgactgcattctgtgcgaaaccgctgttcatgtcagatatcagagataccttgatgactgctatcggccagagtcaggctgaagtagaagattcaattcttccagaagcaggttcagatttcagaggcagatgtatactgcttgtggaagataacgaactgaacagtgaaattgcggtggaaattctgaaagaatatggatttctggttgatactgccgaaaatggcgcagaggcagtggagaaagttaagaattcgactccaggtaagtatgatctggtgctgatggatgtgcagatgccggtaatgaatggatacgaggccacccgtcagattcgtgcgttggatgatccggcactgtcgggaatcaccatccttgccatgactgctaatgcctttgatgaagacaggaagaaagccttggaatatggtatggatggattcttatccaaaccgatagttatagaggagttaatcagtactttacacaacaacctgctggattagagcgtgtttgatcaggtgtttggaacttcagaaaatccgcacggataaaggaaataaggaatatggataaaagtagaaaaaaatcagccgtactatttgtatgtatattgctagttctgggaatgtggatgatgttatcagtacacagccaggccgctgaaacgaataatgatgaaaaacaggcacagaccattcgtgtcggctcatttgaggatacctttaattatgtcgacaaaaacggtgtaagacgaggatatggctacgaactcatgcaggctctggcaggttataccgaatggaaatttgagtatgtgaaatgtgactggtctgactgttttgataagcttgaaaatggtgagattgatattatgggtgatatctcttacagcgatgaacgtgcacaaaagatgcttttttcggatgaaccgatgggtgaggaaaaatatattctttatgctgatttatcgaatatggatattgggatgtctgattttaagtttatggacgggaaacgtgtaggtgtgctcatggatacagagccagaaattatgctgacagaatgggaaaataaaaatggtatacatacagagcatgtaaatgtgaataatgataatgatgtcgaaaagaaattagcgaatcatgagattgatgcttttgtatctctggaggaatccatctggtctgaacagggaatatcatctgttaccactattggcaaatcaggtatatattttgcaataaataaagagcgtagcgatatcaagacggagctggactatgctatgtgtcagctggatcaggatagtcctttttttaaggcagatatgtataagaaatattttacacttgattataatcagagtcttacaggtggagaaaaatcctggctggaagaacatggtgacatccggatgggatttttgaacaatgatccggcaatcttttccatggacgaaacaactggaaaacttaccggtatgctaccagaatatgtctcctatgccaaagactgtctgggaaatcagacgctgaaatttaatatacaggactatgatgattatgatgaaatgcttcaggcactgcagaatcatgaaattgacatgattttttatgccggcagaaatcctgatattgcagaaaaaaaaggctatgcacttacaaacacagcctggacctacaatcttatggcagtaactgatgagaaaaattttgacgagggtaatgtgtatacagtagctgtgccaaaggaaaaagaagctttaaaacagcagcttacctttagttatccacaatggaatcttgtggattatgattcgtttgaggaggctgctgaaatgattactaatgaaaaagcagactgttttctcatgggagcaagtcaggcgatggtatatgataacaatcgagatttcaagagtgttccacttacaaaaacaatggaggcatgctttgcagtaaaaggtggagaggaaactcttttgtcgatactgaataaaactttaaagggcatgccgtctggcatgcttacaagcgcacttgctatctatgacagtacggcagataaggtaacatttttggactttgtaaaagacaatatgcttgctttttttctcgccacaggattctctgcactcagcatcattgttattatcctcgtacttttacgcaaggcaaggaaagcagaagctgccgcaaagcttgctgcaaatgatacacaaaaacttaatgagaaactggaaatcgctttgaaaaaagcagaggatgccagtctcgcaaagaccagttttcttaacaatatgtcacatgatatccgtactcctatgaatgtaattctgggttatgcacagcttatggagaatgaactaaatggaaaagacatacctgaagttttggaacatctggaaaaactgcagcagtctggaaatcttcttctgtcaatcataaataatgtattggatatggcccggattgagagcggaaggatggagattgatgagaattactgccggattgaagatgtctggaaatctttgtttgcagtatttgatgagaaagcaaggaaaaagaatatttcgcttcattacacgatgaatgtagagcatgagcatgtattgacagatgttaccaaggtaaaagaaatattggtcaatattctgagcaatgctataaaatatactccagcaggtggttctgttatggtatatgtagatgaattaccttgtgatgagtctggatacatgatagtgaggatcagaatcagcgataccggaatcggtatgagtcaggattatctgacaaagattttcgaagcattcacgcgtgagaagaacaccacaaagagcaaaatcgcaggaaccggactgggcatgtcaatagtcaagaattatgttgacctgcttggtggaacaatagatgtagagagtgagcttggcaagggcagtacctttacagttacattaaaacacaggatagcggatgaaagatattatgtaaaaaagcatattgaagagtctggaacaggaaatgaaatccttgaaggcaggaatatccttttagcggaggataatgatttaaatgcagagattgcagaggcaatacttgagcgtgccggtcttaggatagaacgtgtggagaatggtattcagtgtgtgaacagaatactgaaaatgccggcaggaacatatgatatgatcttcatggatatccagatgccgcaaatggacggttataaagcaacacagacaatcagaaatttgccagataaggataaagcgtgcataccgattatagctatgacagccaatgcttttgcagaagataaaaaaaagacgatggaggcagggatgaatgcacatctgtcaaaaccattaaatgtaccggaactgatggatacaatccgaaaattctgtgatggtaagcagatgtgtcagcgaccgggaaaagaataacagaggtatagcagaatgaaaaagaattctgttgttatatcattccgtaagtgatatactaaaaagacagaaaaaaaccgtgtggaattacagttttactttcgcatggtttcttttatacataatggttagttgcaactaatatcaaaaatagtatgaaggactacaaaatagtagttattccggttttaaagaaaggaaagtgaaaagcgaatgaatactttttttggcatattgattccatttgttggaacaacgctgggtgcagcatgtgtgttttttatgagaacaacatttagcaaatcagtgcaacgtgcacttacaggatttgcagcaggtgtaatggttgctgcttcaatctggagtcttctaattccggccatgaaacaatcggagaagatgggagatttgtcatttgttccggcagttgctgggttctggattggtatattgtttttactcacacttgatcatttgattccgcatcttcatgttggaagtgatcaggcagagggaccgaaaagcaggcttggccgtactacaatgatggtgttggcagttacattacataacatccctgaaggtatggcagtcggtgtaatgtatgcaggatttcttgctggaaatgcacagattacagcaacaagtgcacttgcgttatcacttggaattgctattcagaatttcccggaaggagcaattatatccatgccgcttagggcagagggagaaagtaagggaaaggcatttttaggtggtgtactttcaggggtggtcgaaccgattggcgcagtattgacaattattgctgcacagctgataatcccggcattaccatatttgctgagctttgcagcaggagctatgctttatgtcgtggttgaagaactaatccctgaaatgtcgcagggagagcactcggatattggtacggttttctttgcagttgggtttagtttaatgatgattctggatgtggcacttgggtgataacaaacaggaaaaggtattagaatataaatttgcggtaatcaattatatcggatttctaagattttcataatcaactttacaaaatctaatcagaatcagtccatccatattccacatggatgcaaataccggaatttctttgatatcagatgtcatttttatcataagaaaatatcctttttcatcccttcttctgcaatattatgattatatggtacattataaatgtggaatttacaaaggttaagcgcataacccattacaaaatttgcattcgatttttgtgatattttactattgcattacgcatttccagcaatctgtgtgttaatcattaatgacattcttatcccacaataaaactgtgtcgtaaaatgtggtaagaaaatcagacgaatatatttttccaaagacttgtcgtaaaaatgtggtcaaatcaagaaaatcgagtgcgaaagcaagtgagaaatccctgtgaagcccgtaaaatcaaagcttcaccaaaaaatctcaaaaaattagcactcgtctcttgacatggctaacagatagtgatatatatatgttatacgaagtgtagaacaaataagcatcttcgggttaggaggaacttatatgaatataaataaatttacgcaaaagtcattagaagcagtaaataactgtgagaaactggcttatcagtatggcagcccggaaatcgatcaggaacattttttatatagcctgcttacgattgaggatagcctgattttaaaattaattgaaaagatggaagtgaataaagaagcatttctgtcacaggtacagcaggcagttgagaagaagccaaaagtttccggtggacagacttatatcagtaagtctttgaatcaggtacttgtgagtgcggaggatgaagctaaggcaatgggagatgagtatgtttctgtagagcatcttttcctttctttaatgaagtatccgaatacagagattaagaaattgtttcaggcatatggaattacaagagagcgttttcttcaggcattgtctacagtaagaggtaaccagaaggttgtcagtgataacccagaagccacttatgagacattggagaagtatggttatgaccttgtagagagagctaaacagcagaagcttgacccggttatcggacgagacagcgagattcgtaatgtcgttcgtattctttccagaaagacaaagaataacccggtattgattggtgaacctggtgttggtaaaacagctgttgttgaaggtcttgcacagcgtatcgtgaaaggtgatgtgccagattctttaaaggataagaaattatttgcccttgatatgggttctttagtagcaggagcgaaatatcgtggtgagtttgaggaacgtttaaaagcagttcttgaagaaatcaaagccagcgatggacagattcttttattcattgatgagctgcacacgattgttggtgctggtaagaccgacggtgcgatggatgccggaaacctgttaaagccaatgcttgccagaggggaacttcactgtatcggtgctacaacactgaatgaataccgtcagtatattgaaaaagatgccgcattggagcgtcgttttcagccggttatggtcgatgaacctacggtagaagatacgatttctattttgagaggattaaaagaccgctacgaagtatatcacggtgtaaagattgcagacagtgccttagtaagtgccgctgttttatctaaccgttatattaccgaccgtttcctcccagataaggcaatcgaccttgtggatgaagcatgtgcgatgattaagacagaattagattcccttccggccgaccttgatgaagtgcagagaaagattatgcagttagaaatcgaggaagcagccttaaagaaagaaacggatcgtcttagtgtagaacgtcttgaaaatctgcaaaaggaactcgccgaattacgtgaggaatttaagtcgaaaaaggcttcctgggatcaggagaaatccgcagtagagcgtgtttccaagttaaaggaagaaatcgaaagtttaaataatgagattcagattgcacagcgcaattatgatttaaataaagcagcagaattacaatatggtaaattgccagaattgcaaagacagttagaggaagcggaagaaagtgcaaagaagagagaatcttctatggttcatgaatctgtaactgatgatgaaatcgcaacgatcatcagccgctggacgggtattccggtagcaaaacttaccgagagtgagagaaataagacattgaatcttgataaggaactccataaacgagttgtcggtcaggatgaaggtgtggaaaaggttactgaagccattatccgttcgaaagcaggaattaaagatccgacaaagccaatcggttcctttatgttcctcggacctactggtgtaggtaagacagaacttgcgaaagcacttgccgcaagcctgtttgataacgaacagaacatggttcgtattgatatgagtgagtatatggagaaatattccgtatctcgcctgatcggagcgcctccaggatatgtaggatatgaagagggcggtcagcttaccgaagccgtcagaagaaaaccatactcagttgttctttttgatgaaatagaaaaggcacatcccgatgtatttaatgtgctattacaggtacttgatgatgggcacatcaccgattctcagggcagaacagtagactttaagaacacgatattaatcatgacctccaatatcggttcccagtatctgctcgaaggaatcgatgaaaatggcaacatcaagaccgatgcagaaactatggtcatgaatgacctgcgttcccactttagaccagagtttttgaatcgtcttgatgagattatcatgtttaaacctcttaccaaagacaatatcggaggcattattgagcttatgcttgccgatgtcaacaaacgtcttgaagacaaggaactttctattcatcttaccgatgctgccaagagttatgttatcgaacatggatacgaaccggcatacggtgcacgtccattgaagagatatctgacaaaacatgtcgatacccttgctgcgagaatgatactttccggcgaggtatatccacaggatacgattgtcattgacgaacagggtggagaactgattgcttctgtggaacatagacaatgatgatttaattcattaaacaacggacaaacagacgaatccatgaaataaaataatccatatctgtgactttagtcgcagatatggattattttatttcatggattcgtctgtttagccatttgcttaccgaatggagcagtaaactacaattcattattcaccatataataataaacctccgcaaggaacttagaattcgttggagctcctttatctgaataagaggagcaatgaaaaattttctcaatctcttctaaatcaccttttaaaaatccaatttcaatcgcatgccgaatgtttcgttcgacccgggcggctgtactcgaacattttttagcaacatcgacatataacccttttgtaatgttgtttaaataatcaggatcaagtgcgataagttctaatgcggttactatgtaagaaaaaccaagcatattagcgggaattccgatttgcatcaaaagtttttgaattcctgaggtttcgatgcgtaaaacatttttaaaatcattttcactgtttatagtaaaaataagtactttttgatgatcttccatagtgtcgataaatctgaaaaggtcatctttaacatggaaaattcccgcaaaatcaataaaaacgttagacatatattatatccccttcctttttgttatcttttacattttaatatgtatattgacataataaaatattaggaataacataacaattataaaagtttttaaaaagttatgtcagtaatgacccgtgggagacaagatgttcagtgataagattcgagaattaatgattgagagggatatatcccttacggatttggcggaactttctggagttccatttgagacattgcgtaatatttattatagaaaagtaaaagatccaaaagtatcgactgcttttcaattagcaagtgcgcttgaagttaccgttgagtatttattaaaagatatgagtacgacagaggaagaggcggagaattcagaaggacaggagggcatagaggaagaacttcttgaaaattatagagagtgtgggaatcatggaaaggcaattattcgtttagttgcccggcttgaatgtaaggcagcaagaaaagaaagattgaatttgcgtaaaatgaaacacagaatcccatgttttattccagtaggccgtattggagatggtattgattacaatagctgtacggtagaagacgaatacacaatgattaaaaaggtttatctggctattgagattactaataataactttgctcctgcatattgtaaaggagacaggatattattagagaatcgtttccctgaattaggagaatgtgccgtatttacagatggaatgaaagcttatttccgctattttaaaatggaaggagaaatgtactgtttaaaatgcctgaatggaagagggaaagatatgttgcttcggcgaatggatgaagtagactgtctcggcacctgtattagtgtgattaggaaatagggcatataggggttctattgctcggctgcccttcgagaacatcagttttgcttcgcaaatcagaaaatgtcaaatattgagttttgcattatcttgtgataccatataaatggatagttggacatttcaatgaaaatagctaaatattttataaatggggcagattttgaatgagtatgatattgggatatataaaggaacgagaaatatcttttctgttctttctattgttggttctgttagtaattgttctttggaatttgtacaaaaaggagaaaaagagagcagaagcagcagaactctctgtagccggtgagcggaaatattacgtggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgcacactgtctaaggtatttccatacttgaattccgttacatcggtaacccatttctcattaaggtgttccgccttaaattctctattaagaatgttttctgcaataaatgctgggttgtttgatgctctggtacagccattataccggctctttaagttggaccggatctgtttttttctgcaaatacggaggatcctcttatcatttacctgaatatcttcatcgtgccgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttctttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagtccatccaccccgttttcttcatatcttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgggcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttaactgtctacctaaaagggagcataccacaatttattgaattttgtgactttgtgctgcgggattttgaccatagaaacttcgcattcgtttctgcgaagtttctgttttattgggcaaaatggagcgtttagcacaacggaacaaaatcaataaattttttagggcttcttcctgttaatcttctggcaatccgattgtttgttcttctataaaggagtttcctttgcctgcggcaactcagaatttttattcataatcctgtccatcaaatctttcatcccctgacaggcggttaataaactttggatggtatttagagtagacaataatctgttctttgtacaaaccatgatagccggaaagcatatagctgatggagatggcaattaagatataggaaacaccttcaaatccaaacaattcaaatccaataagcattgaagcaatcggacagtttgtcacaccgcaaaataaagcgagcattccggttgcagcgcaaagagagggagatatgccaaagatatgtccaaacagacagccaaaggttgctccggtgaagaaagcagggacaatctcgccgcccttatatccggcagcaagcgtgagtgcagtaagaagcatttttattaaaaaggcataggccgggacatttcccgcgatagctcttgcaatcatgtcagttcctgctccattgtaatcataattgccgattaggagggtgattgcaataacaagcagaccgccgacaatgattcgcatgtaaggttttttaaaaaacttattgtaaaataaaccagctccctttaaaaatatacaaaatacaacgcttaatccagcacagaaaatgccgagcagtacgattttagcgcaacttgtgaaggtgagttctggtattccgtggatagtaaatgcttccgggttgattcccatattgacagcaaaacgatttgctacaatagaagaaaatacgcagggaactaaagcggcataatgcatgattccgacactgatcatttccattgggaaaatagctgccgcaagaggagttccaaatacggcagaaaaggcggcactcattccgctcatgacaagaagctttcgatccccctcgtcaaatttgaaaagccgtccgattgtatttccaatacttcctcccatctggagagccgctccctcacgtccggcagagccaccgaataagtgagtgataattgttgctgcaaagataagtggagccatatatgcaggcacatcctgattttttccatgtacagcagtcataatgatgttcgttcccttatcctgccttaccccacaaagatgatataaaaatacgataacgacaccaccaatcggcagaaaatataacaaaaatggatattgaccgcgaagtgtggttactttttttaagcaaaaagaaaaggcactactaaatgccccgacagcaaccccggtcaatactgccataaaaagccataacgcacaagtctttaaattgtagtagatctttcttagatagcgttttatgatttcttccatgatatttctctcccttgtgtatttcaaaaaaatttttgtcattttcaaatgtttagaaaaagcattttttcattccttcttaatatcagaaaaaattacgagatttatttggttgcatcaagaatgccggggcattcttgaaaccatattaagaagagagaaaattcgatttctttagacattggatttctttgtacattggatttttgaatacattttgtttcctaaaaagagtgtactctattcgaattcatattgtcaagttctgccgaaaaaagaattgacatcctttttatttcgtgataaattaaatgctgtaaatgcgatgaagaggaatagtagaatgatgaaaacatccagagagctgctggtcggtgcgaagcagtagtggacatgatttgaactcgcctctgagcagcctgttgaaccgcatgattgcagtaggcagcgccggaaacctgaccgttacagcaggaggatataaggctttttaagtccgtatctgtaatgagtgcataccttactttttatgtatcgtatgaataagagtggtaccgcggaattattttctccgtctcttttcggcatctgccttttggtatttgccattaaagagacggagttttttattttacaggatatatttcctgtaatatgttgtttttaacttaaggaggattttctattatgaagtatgcagataagtataaaccaatgtatttcccagctccagctggatataataaatggatggagaaagaccatatcgaacagccgcctatctggtgttctgttgacttacgtgatggtaatcaggctcttatcatccctatgagtttagaagaaaaaatcgaattctttaaattattagttgatgttggttttaaagaaatcgaggttggtttcccagctgcttctgagacagaatatgaattctgccgtacattgatcgaacggaatctgattccggatgatgtaacgattcaggttctgactcaggcaagagaacatatcattaaaaagacatttgaagccattgagggtgctaaaaacgtaatcgttcatctgtacaactccacttctgttgcacagcgtgagcaggtatttaaaaaagataaagaacatattattcagattgctgtagaaggtgctgaattattacagaaactgatggaagaaaatggaggaaaataccgttttgaatattctccagaaagttttacaggaacagagatggattttgcattagaaatctgtaatgctgtattagatgtatggaaaccaaagaaagaattacctgccatcatcaatcttcctgctactgtttcccactctctgcctcatgtttacgcaagccagattgagtttatgagcgagaacttaaaatacagagataatgttgtgttatctgttcatcctcataacgatcgtggaacaggtgttgccgatacagaattagctgttcttgcaggagccgatcgtgtggaaggaacattatttggtaatggagaacgtacaggtaatgtagatatcattacattagctttaaatatgtatgctcatggtgtagagccaaacttagactttacagacttgccacatatcgtaaaagtatatgaaaaagtaacaagaatgcatgtatatgaaagacagccatatgcaggaaagcttgtatttgctgccttctccggttctcatcaggatgctatcgccaaaggtatgctgtggcgtgaaacacatgactgcgataaatggactgtaccatatctgccaattgatccaaaagatcttggaagagaatacgaagcagatgttatccgtatcaacagccagtctggaaaaggcggtatcggattccttctggaaaaaacatatggtattcgtattccaactaaaatgcgtgaagaagttggttattctgtaaaagatgtttccgaccatacacataaagaattacagccaaaagaagtattaaaagtattcaacgaaaaatatgttaatatttgtgatccaattgaattactcgaagtacacttcaaacaggaacacggtggaatttcaacagaaattatcctgaacaaatatggcgtacacaaagtataccacggaaaaggaaatggtcgtcttgatgccgtaagtaacgcattaaaacgccactccaacttagattacacaatctccacatatgaagaacatgctctgaaaatgggttcaaattcccaggcatgtgcttatgttgctatctatggaagcgatggaaatacatattggggagttggaattgatgacgatatcatcaatgcttcagtgaaagcgctgattagttctgtaaatcgctatgagaggtgcgaagacggcaaggaagattaatttctgatttgccgcaggcaacgggacgcccttaaagagagcctatcccctatatttgtgactttagtcgcggcggtttgaatactcgcttatacatgcccgtatccaaaccttgctccgagaccacaaatataggggataggctctctttgagggctgtttattggctgcaagagcaaaatcagactcctttattacgctctccacatcttacgcagaaaaaactcaaaacgattctttgtccagttctcatccttgctgacacaggagatcttattaaaagagaacatattcgctgaatcagttatcaaatactaaaaagctatcttgttttcataaagggacaacacatcttgatttttataaaaaatggaatgctattatccttttataaaaagatttataaaagagagagaagcactttaaaaaagaaagttttgtttcaacaatatgaccaattaacgaaacagtacttataaaaaatcagtatatttcagatattgacagtaaaaaaataattgtgtaaaataatgttagactaagaggaatttcctatttgataaatagtgataaatatattagagcgtgttttaaatatgcgctgaaacataaattttatatttgggtaaaactgtcgaaaggcagcgacacaaagccaaatgggtctaaggttcattttttaagagaattatgacagccggttgcatcaagttattgattattttaatgagtaatttctgctcattttatgccgtctgtgtaagggttatcttcacaggcggcttttttaatgcttaaaaaatggaagattctaaaattataattggagatagaaaatgaagttaaagtggagagggttacaatttgaacattatatattgggaattttactggcagtagagtggattatgtcatttacttttttgggatatattcatatacctcctatttccattactacagcgcatattcctatcgtagttatcgcatgccttttcgggccagtggaatcctcagttgcaggattattttttggactgggaagtatgtataaagcatccgcattgtatgttatgctgggtgacagaatattttctccatttcagacagattttccgataggaagtatcttgttaagtgtaggaacaagagtattatttggatttttaatgggatgtatatttaaaattgtaaataaaagccgttataaatgggccggcaaaagccttgcagcattaatagcaactccgttacatgccttgcttgtgtacggagcaatgggaatccttttcccagaaagtggatttaattataagtcttcttttagatggggagtaaatgattatgctatagccgcaatctgcattttggcggtaatactatcagatattatttatcatagctcttttgtaacacattataaaaatgtgatcaatgattcagaattaagacagcactggtcagttaaaatgaaaatgagtttgttcattattataatatttgtattctgcatagcagctttttccacaatatattttgcaagccggacagaatatatgtttggtgtatatggtgtcaaggtaacgaagaaaatagcacaggacattcttcatttgcaggtacaatttctggcagctatgatttcactgaactttattctgatagttatcattttgatgatctataattacatgaaacatagagaatatatgggcgagatggatgcccttacaaatgttatgggaagaagactatttttaaattattgtacgaaatgtcagaatgatagagatgatatagataacaaatcgaaaagaaaaggctggtttttatttatagatattgattggtttaagcagattaacgatacattgggccatacggtcggcgatgaaacattaaagcagattgcagaaagcttaaaaaatatattcagcagctatggagccgttggccgggtaggaggagacgaatttgcagtaatcatcaatgagaaaatgacgaaagaacaattagaggaacaactaaaaaagttcctcttagatatttcagccattttaccagaaagaaccgttagctgtagcattggtgtttatcatttcggatttcccaaaagtcagaaagaacttcttacgagaacagatgatgcattgtataaggcaaaagaaaagggaagagcctgctatgtgatattggatgaataggaatttgtcggaggcaaaagaggggatagaaagtaaaagacaatctggtattgatcatggtgtttacggagcaaaatatatttatgatttatcaggaaagtacggaccgaatggaaggatagtgggtgaactactcgcaaatgttatttgctatcatcatggaggactcccggatgcagaagattttaatggagacagcccattgttgatgagacttcaggatgaaaacagacttactgattatgagcaggtaaaagtagctttttttaaggatttacagattacggaacaggagatagaacagctttttaagaaatctgttgaagagataaagctgctcattctgaaatcttctacgggaagtgaggcaagtatataagcaaaagtttgaagagtacctttctggattgcaaaagaagtcagagactttagaagatacaggtaaaaaagttttggatattttttattatatagtgtaagcctcttttaaacaatacttcctgttgattttacagatgacaatttatccttttctagcaagaagactccgacctctaaggtgggagatgaattgcgtctgttacctactttatattgcattctaatcatagtataatatattcagtcgcatgataaagaaaggctgaaatacaatgaatttagataataatacacattcagtattcttactgcactatcatcttgtgcttgtggttaagtatcgtagccaggtttttgatgatggtatttccagcagggcgaaagagatatttgagtatattgctccaaactacaatattactcttgaggaatggaagcacgataaagaccatatacatatccttttcagggcacaccccaatacggaaataagtaagttcataaatgcatataagagtgcaagcagtagacttcttaagaaagagtttccgcagatacggcaaaagttgtggaaagaacatttctggagccagagtttttgtttgattacaacaggcgatgcgccaattgaagtaatcaaaaaatatatagaaagtcagggacaaagggaccgaaaaaggaagtgacagagtggcaaacagagcatataaattcagaatgtatcccaatgatgaacagaagattttgcttgctaagacttttggatgtgtcagaatggtgtataatcattggcttgatagaaagatccggcagtacgaggagaacaagacaaacgtaacatataccatttgtgcaaaagaaatggctgcaatgaagaagacggaagaatacggatttttaaaggaagcagatagtattgcattacagcaatcgctcagacaccttgatacggcatttcagaactttttcaaacagccgaaaacaggtttcccaagattcaaatcaaaaaagcggaataaaaacagctattctacggtctgcatcaatgggaacataaccatatctaatggatatttgaaattacctaagattggtcaagtccgcttaaaacagcacaggattattccagaggaatacagactcaaatctgtaacagtaagtcagacaccaagtggaaaatactatgcaagtattctttttgagtatgaagaccaagtacaggaaaaggagttgcaaaagtttttaggtttagatttttccatgcatgaattatatcgtgacagcaacggtaaggagtctgcctatccaaggtattacaggaacgcagagaaaaaattggcgagagaacaacgcaggctttccaaaatgcagaaaggttcaaacaatcgcaataagcagaggcttaaggtggcaaaacttcacgaaaaggtttccaatcaacgaaaagacttcctgcataagcagtcaagacagatagccaatgcctatgattgcatatgtatagaagatttggatatgaaagcaatgtcacggtcgttgaaatttggaaaatccgtttcagataacggctggggaatgttcacaacatttttgagatacaaactggaggaacaggggaaaaagcttgtgagagtgggtagattttttgcaagcagccagacctgttctgtttgtggttacaaaaatgcaaaaacaaaaaatcttgcgttaagagagtgggattgtccgcagtgcgggacccatcatgacagagatgtaaatgcggcggtaaatatcagaaatgaaggaatgcggctggtaaatgcatgacattaacacaatataacacaaccgtgggacacacggggatagctcgcttatgcttagcacagtagtgttatcgaacgagaaccaaacttgccgaggttgggaagcccccacctctataggatgtcactgaaaaagtcctttttacgtgtaaatcaatacaaaataaagtatgtttgttgattttacaatactatatattgcatgtaaaattagtttttcagtggcgtcctataggtgggggaggatgtcaccaagcagtttcccatctacttaaaaacatatattctgtattctaatttcgtctatctgtctgtccacccaacgaattaaacggcaaacatcccatcaaatagtctcttttgtataaaaaaattaaaattatcgtgaatgttgcaaaaaaatacagtccatgataaatttttgcaaaaaaatgacggaaaaatatagcattttttatttatttgtgctatactcatattgcgcgtgaggaaagcgcataaagtaatgttgatagttaattgaaggaggaacacaacaatggcaaaatgggtatatctgtttacagaaggcgatgccacaatgagaaatcttcttggtggtaaaggagccaatctggctgagatgacaaatattggattacctgtaccacagggattcacaattacaacagaggcttgtactcagtattatgaagatggtcgtgagattaacgatgagattcagggacagattaatgagtatatcgtaaagatggaagagattacaggaaagaaattcggagataaagagaatccgcttcttgtatcagttcgttcaggtgcccgtgcttccatgccaggtatgatggatactatccttaacttaggtcttaatgagacagtagttgaaactattgccgctaaatccggaaacccacgttgggcttgggattgctacagaagatttattcagatgtattctgatgtagttatggaagttggtaaaaagtattttgaagaattaatcgatgagatgaaagctaaaaaaggtgtaagtcaggacgttgatcttacagcagaagatttaaaagagcttgcatctcagtttaaggctgaatataaagagaaaatcggcgaagatttcccagatgatcctaagaaacagttaatgggagctatcaaagccgtattccgttcatgggataacccacgtgctaatgtttaccgtcgtgacaacgatatcccttatagctggggtactgctgttaacgtacagagtatggcatttggtaacatgggagatgactgtggtactggtgttgcatttactcgtgatcctgctacaggtgagaagaagcttatgggagaattccttacaaacgcacagggagaggacgtagttgccggtgttcgtacaccaatgccaatcgctcagatggaagagaagttcccagaagcattcgagcagttcaaacaggtttgtaaaactcttgaagatcactacagagatatgcaggacatggagttcactgttgagaataagaagttatacatgcttcagacacgtaatggtaagagaacagcacaggctgctttaaagattgcctgtgatttagtagatgagggaatgagaacagaagaagaggctgttgcaatgattgaccctcgtaaccttgatacattattacatccacagtttgatgctgctgcattaaaggctgcaacaccaatgggtaaagcacttggagcttctcctggagctgcttgtggtaagattgtcttcactgctgaagatgctaaagcttgggcagagagaggggaaaaagttgttcttgttcgtcttgagacatccccagaagatatcgaaggtatgaagagcgctcagggtatcctgacagttcgtggtggtatgacatctcacgcagcagtagttgctcgtggtatgggtacttgttgtgtatccggttgtggtgacatcgtaatggatgaagagaacaaaaaattcacattagctggaaaggaattccacgaaggagatgccatttctcttgatggttctacaggtaacatctatgatggaattatccctacagtagacgctacaatcgctggtgagttcggtcgtatcatggcttgggcagataaatacagaacaatgggtgttcgtacgaacgctgatacaccttcagatgctaagaaggctcgtgagcttggagcagaaggtatcggactttgccgtacagagcatatgttcttcgaaggtaacagaattgatgcattccgtgaaatgatctgttctgatacagtagaagaaagagaagctgcacttgataagattcttccatatcagcagggagactttgagcagttatttgaagctatggaaggtaatcctgtaacaattcgtttcttagatccaccactgcatgagttcgtacctcagacagaagaagatattaagaaacttgcggatgcacagggtaaatcagtagaaactattaaagctattattgaaagcctgaaagagttcaaccctatgatgggacatcgtggatgccgtctgacagtaacatatccagaaatcgctgttatgcagacaaaagcagttatccgtgcagcattagctgtacaggctaaacatgctgactggacaatcgttccagaaatcatgattccattagtaggtgaagaaaaagaattaaaatacgttaagaagatcgttgttaagacagcagacgaagaaatcaaagctgctggttctgacatgaaatacgaagttggtactatgattgagattcctcgtgcagcattattagctgacgaaatcgctaaagaagctgagttcttctgcttcggtacaaacgacttaacacagatgacattcggtttctcacgagatgatgctggtaagttcttagacgcttactatgatgctaagattttcgagaacgatccatttgctaaacttgaccagaatggtgttggtaagttaatggatatggcagttaaattaggaaaaggtcagagaccagaattacactgtggtatctgtggagaacatggtggagatccatcatccgtagaattctgtcatagaattggattagattacgtttcctgttcaccattccgtgtacctatcgcaagattagcagcagcacaggcagcgattgcggaaaagaggaaataggaatagacaatcatatatttacctctgtacgctaatggtaactaaagcagatgtgcaggcctttatggctgaacgttcagagtatacaaaagcgaacagatttgaagatattgaagtaaaagtctatatataaagttctgcgagggaaagcaacattgctttccctcgtttcatgtttgggaataaaccctaattatcagggtttgttcctttttttattttcattatacgaggaggtttattatgaacaggataacattaaatttagaaaacataaaaacctagagttaaatctatttacatattatataaaatttaactctgaaaagataaaattaaggagagattgattatgaaagtatatgtagtagcaaatttaaaaggtggcgttggaaaaaccaccacaacagtaaacgtagcttatacattttcggaaatgggcggaagagtattagttattgacctggatccacaatgtaactgtacaagattttttgcaaaggtaaacggatacagtaaaacggtaagagatgttcttgagaatcctaaagggataaatagtgcagtctatcgtacaaaataccaggatatagatattgtgaaaggttctgttaagatcacagagcaaaagactccatggagactgaaagaagcgttaggatatttaaagaaagactatgatgtctgcctgattgatacccgccctgtatttgatatgctgacaatgaatgcattgtatgctgcggatgtgttccttaccccagtgaaatttgataacttctgccgggataatcttacaatggtggaagatgcttaccatgagatcttggaaaacaatccagatctggagtggaagatattcgcaaacatggtgtcgaacaccaaagcacagaaattatcttcagaggatctgatcgctaagcatgattatccgtttttacagtcatgtatcagccgtacagcgattgttgataatgcgttatccctttataagccggtggcaaagcatcgtgttatgagtaatgtagcacaggattttgtagatctggtggaagaacttcttgaggattaggggtatcggttatggcaaagcttgggaatatatttaataaggaagagattaaaaaagaagagcagcatccacgaagaacgatcaaatggatccattactctaaactgaaaacaaatccagatcagtattgtcctgcaagagataaggaagagatagaatcccttgcagatctgatcgaagctgcgggagaagtcattgaaaatctgtccgtaagtaaatcagatacggatgaataccggattattgccggacataaaagatgcgaggcatgcaggttacttgtagaagagagaggactgaaacagtttgaatttctcccatgcattgtaaataatgttagcgtagtacaggaaagtttccgtgtactggcttccaatggctatcatacgaaaaagccatatgagctgatgcatgagattacagagatggagagacttttatgggaacatccagaagaattccccccttctttacagaaaggtagaatggtagaacgcttatcaaaaaaaatggggattgcaagggctacggtacaggagtaccagcagatctccagaaatttacttccagaggcaatggaaaaatttaaggaaggggagatagaaaaatctgccgcactcactctggcgaggctgccggaaaagatgcagaaggaagtgatcgaacaggggattacaaaaaatgtggatatagaagaatataaacagaagaatttagaaccgggtgcggtagagatacgggtatcgtaccggctgttgggtatagatgaatatgacaggtctactgtctccagaaaagcactcgtaaagttcttaaaagggagatatgggagtacatcatatgaaatatcacaaggggagatcaggatctcctgctcggataaaaacatcagtatctcagagagatccattacatgggaacggtatgtgaccctgcttgaccagtactgcccaaaagaagaaaaagaagagccagagcctgtagaaaggagggaagaacaaagagatatggtatcagaaatagaaacagaagatacagactgcaaagagcctgccggaaagccggacagggaaggaagggaagtttctgtctcgatggatgagttagtggaagaaggaagggaagaaacagctggattaacccgtcaggaatatatgaattctttagatataaaaggggtttccagttatatcagctattttcttcctgaagaaatcttgcggtgtccggcattgattgaaaaatggctaaaggactgcgtaaacgaagaaggacagtccgtataaaagattagtattacatacattctgcctgccggatggagaagaccatgccgtagctgcaaaagcacaggcagaattcgccactatttgtgtgcagcatatactttcatgtaagggggatccctttccaggatattcccctttacattggaaaagagaagagaggagaaaaaagatgagattggactatttttacaatacagagggagaaaacttccgcttttaccagatcccggcattgcttttggaggaagagaaataactggattgaaaaagatactggtcgtttatatatcacatacaatctgaaacaactggtagaaaaactgggacgcagtgaccgtacgatcagcaaagcaatgaaacagctttccgaagttggactgatcgagaagaaaaaaagaggccagggtaagccagacattatttatgtgatgaactttacggctgtccataaagaaggtgcaaaagagattgtccttgaagaacagatggagcaggattatcaagataaattagcctacatattgatgcatccattccgtaactggttcaatagaaaaacaccagccgttatagggattgccctgactgtatgggcaatgtttgtctgttattatctcacttattaccgtaattttcatcccgatgcagaacatggtgttgcagaatgggcagatgtaccaaagacagctaaaaggctgtatggaaaaggggaagaacctgttacctgcctgagtaaaaatattacagtaaatgcaaaggcattgccaaatatgcatatcctgatccttggcggttctggtgatggaaaaacgacttcgcttttaattcctaacattttacttgctaatatgacgaacattatcttagatgtaaaaggtgacctgttaaaaaactatggggatatttgaaagaaataaagaatataacagtaaaaagccttaatttcaaggatatgttacaatctgaccgatataacccttttgtatatattgataattacactgatgtgatagaacttatcacaaatatccagacatctgtaaagccgccggatgcccaaaagggtgatcccttttgggatgatggtgttggtctgtatctgcagtcgctttttgagtacgaatggcttctggcaaaagaagggaatagagtagcttcaatgccaggaatattggaattagttaatagagagacacaaaaaacagacgaagaagggacaacgcagctacaacaggatatgcaagagttacaggaaagataaggggaagattatccgccagtgagagattaccgcaagttaaaagaaggtgcatcagaaaccgtacgctctattgttatcatggttaatgcacaattacgtctttttgaaatcccggagattaaacgggtatttgaaggaacagacgacatagatattccatcactgggattaggtgtagagggaaatcctaagaaaaaaacagcattgtttcttgttatgccgtctggagattcttcctataatctttttatcaatatgttttatacacagttatttactgtattaaaaaggattgcagacaatcgaagagacggacaattaccaatccatgtacggctgtgggcagatgaatactatgccggtcctaaaccacttaactgtgagacacttctgggggaaatacgaagcagaaatatgtccatcgtaccaatcctgcaagatattgcccagataaaaactttgtatcctaatgacaaatgggagatattcacaggaaactgtgcaacgaccgtattcttaggctccggagctacagcccatacaacgcatcagtgggtatcagatatgttagaggacatgacaatcgacagccgttccgaaagcctgggacattcgcaaggcagtggcaatctgcagatgagcaaggccggaatgaaattaatgactccgggacagatcagccggatgccgaaaaacgactgcatcctgttcctaaagggagaacgccccatctacgataagaaaaactggccgttcaatacataggtatttaaagaagcagagaagatagccggacaaaatggctataaaaatccagtatatgtttcctatgatgaaagaaataaaaaatatatcacaacccgttttgagtcaagattgaattacatttcaaaagaagagtttacattttttgaagaaaaagcaaaagaagattccagtattcagacgttccagatagacgaagaagccttcctttaccttaacttcaatgaaactccacagccaagcctgagagaactggaaaagatggtaaaagaaatacaagttgcagaggtaaacgaagaggaagaagaaaaagagacagaccagcagccagatatgctacaggatagaggacaatgggacttatcaggagacattattgattgctttagacgatattctagtgagctatcaccagaagaacaggaagagattataaaaggcattgaagaaggtatgactgattaggatgtaaaacgatactttacactggtaggtgcagaaaaaatgcggcagtatcggagagtgttgatggtcgcaaaaataagagatgaggataattaaatattatttttgcatcaggtatctatacctgttaggcataatgcgtggactgaattaaaaaaatatagtataatctgtattagaaataatgtcgtgaaatcggaattttacggagtggacagaaatgaacttagaacttattctaatgtccgaaaatgacattgctgaatttaagaaaaatgtacagtgtgcatttcaaaaaggatttgaagatgtgtttggtaaatgtgaagaaacgattcttccagaaaaggacatagaccaatccttaaatggtaaaggttcagtagtatataaagctgtgttggatggagaaactgttggtggtgtgattgttgcaatcgacaccgaaacgcaacataatcatcttgacttattatatgtaaaaagtggtgtacaaggaaaaggtattggaaagtctatttggtatgcgattgaaaagttatatcctgatacaaaggtatgggaaacttgtactccatattttgaaaaacgcaacatccacttttatgtgaatatttgtggatttcacatcacagagtttttcaatgagaaacatcctatgctagatacaccagatgattttattggggatggcaatgagggaatgtttgtatttcagaaagaaatgtaagatttgaagttgcagaattgataaatttacctttcgaagaaaaaacagtaatcttgtataagaataaaaaaacaagcattatccatcaattcaaatataaggtaaaaaagagtatcaaccgacgaggagaaaaatagacgaatattacaagtcttgaaattgcacaggcaacaatggatatgttcttttgtttgttctgtctaataatatttgtttcaattaaagcaaataatccaaaacagaagagtatgaggatgttcgttcgattatttcttattgctacagttctgttttttggagagactttggcatatatttttagaggtaaccttggtctttttaatattttagtaactagaattgctaatcttatggtatttgctatgaacatagcaatggcaaatacctatgttaggtttgttagttctgtttttgttgaaaaaggtgctgaagtaagtggcaatagtgttaaaattgccaatatcttttcgtgcattaatattttcattgttgtggttaatttgttttatccatggatgtattatttcgatgaggcaaattattatcacaggaataattcctggtatgtatatacactaatatcacttgtcgtcatatttataggagcaggtatggcgattaagtatagaaagtatttgaaaaaacgaagcttcatttcaatgattctgttttcgtttattccaataattgcaacagttgtacagtcctttatttatggattttctataaccaatttaggactgggaataggttcagtcgtaatgtttgctgcatatatgtatgattggtctcataatggggatgaacatacgaatatgattaatgacagcagatttggtgctgttattatgtttatcataatgctacttagcatgagtgtttccatcatagcatgtgtgaatgtgatccagcaggtaactaaggaaaactctgaaatacagagcagaacaattgcgcagatggtttcagcaaagattgagaatgaacttattaagccaattactgtttctcagacgattagcagtgatattgatataagaacctacatagaggggaaaaccagagaagaggcggagagtgtcaaagacgatataactaatcgtctggtatccattggtaatgaatttgattataaaatggtatttgttgtttcggataaaacaagagcatattatacatataatggaataagtaggtatcttgatgttgaaaatgacagccatgatatatggtataaggattacttggattcagggaaaagatatatagttaatgttgatactgatgaagataataacgggagtctttcggtgtttattaattacggtattattgacacgaatggagacattttgggagcatgtggtgtcggagttgatatgaatgaccttgtagacatacttgccaggttcgaggaagaatacaatatcaaagtatatttagttaatcatgatggacttatacaggttgatacggatgtaagttctataggaacaggctacttggataattcatattttggcaatatatcagatgatgatttttattatcagttatcgaagaatggctgttatatgaccaagtatctcgaaggatttgattggtatatagtaataagagataataatcctgttaaattggatgaaaataaaattatacttccaattgttttaatctttattgcaggcgtattaataatggcaacttcatttgttattattagtatgagagagaagaaggcaaagaatgcatacaacagaagatatgaagcatctataaaggacgagcttacaggcttatataatagacgagggtttgaagttgactgtgaaataatcaagaaaaataataacttaatagaatacgttcttattatgatggatttgaacggtttaaaagcagctaatgataatattagtcatgaagcaggagatgagttaattattggcgcttcgaagtgtatggataatgcattctcaggtcttggaaggacgtatcgtgtaggtggcgatgagtttgctgcattactgagaggaacgagagaagaagcacaggatgcagttaagacatttgattatttaactgaaaacttccagggaaatcttatttctgaacttagtgtgtctaagggaatagttgtttgttcagaacatatagaacttaattttgaagaaattaaggcaatggctgataagttgatgtatgcagataaggatgaatattatagacgaacaggaaaagatagaaggcgagtttgatttataaattgatatttaatctatgtaaagaacccaacaacttccagtttgatggagaaagcaaaaatcagtcatgccctttatcatatagtttctgtatattttttggaagtttgtcaggcaacatggcatttatagcatcttcgttaccatctttcattgctgtttcgtaataccagcacttgaattttaagagggagagagttttttgaagttcttgaatttcagtttcaacagctgattttctggcttcaaataattctttccttttttcatagctggagctgccttcagatacccagataaaaaattgctttatatctttaatctcaagaccggatttcttcagacattcaataatgcgaagagcttccaattcattatcgctgaaataacggatgtttcccttacgttccagattagggaaaaaaccttccttgtcataataccttaaggtagaaacaggaagaccaaacattgcagaaacctgaccgattgtatacataataaaccttctttcaaaacgtgcttgacctaaagtcaactttaggttgtatgatgtttatatcatatactattgttagtatatttacaagaaattttgtatatggaaggatgataaatatgttaaaaacagaagaattacagctggtatctgaatgggataaaacttttctacagagtgaaaaagtagatcatcagaaagtgacatttataaatcgttatggaatcacacttgccgcagatctgtataagccgaaaaatacatctgggaaatatcctgcgattgccgtaagcggaccatttggcgcagtcaaagaacagtgttccggattatatgcgcagacgatggctgaaaaaggatatcttaccattgcatttgatccttcttttacgggggaaagtggaggcaatccaagattcatggcttctccggatattaatacagaagatttcatggctgctgttgatttcctttctgttcgggaagatgtggatccagataaaataggaatcattggaatctgtggctggggtggaatggctcttaacgcagctgcactggatacaagaataaaaacaactgttgcatctaccatgtatgatatgactagggtaaatgcgaatgggtactttgattctgagaacagtgaagaagcacgttatgcgaagaaacagtcgctgaataccctcaggacagaagaataccgcaaaggcgaatattccagaggcggtggttgtgttccacttccggtaccggaagatgcacctttcttcgtaaaagattacagtgagtattataaaggcagatgttatcataaaaggagcctgaattcaaatgatggctggaacagtattggatgtatgtcatttatgaatcagccaatattaaagtacagtaatgaaatcagaagtgcagtccttatcgttcatggagaaaaagcacacagctattattttggaaaagatgcttatgaaaatatgatcaagaacagcaagtacacatctaataaagaactgctgacaattccgggagctgttcatacagatctatacgataatccggatgtgatcccatttgacaaaattcagaaattttttaaagaaaacggagttggttaattatgacgtgtgaagaatatttgagtaatatgaagcccggatatatcgtagatggtggaagtgaagaacatctggttatgcatgagctgtctcaaagggcattaaagataacgatggagctgaataacaaatatcatacaaaagaagaaattatacagcttatgtcggaacttaccggacaaaaaatagatgaaagttttggaatgtttcctccgttttatacagactgcgggcgaaatatccatataggtaaaaatgtttttattaatgcaggatgtaagtttcaggatcagggtggtatttatatagaggatggagtcctgattggacataatgcagtattggcaacgatcaatcatatggaagatcccgagaaaagagcaggtatgatatttcagccgattcacatcgaaaaaaaagtgtggcttggagcaaatgtaacggttcttccgggggttacgattggtgaaggttcggtcattgcagccggagcagttgtaacaaaagatgttccagccaatataattgcggcaggagtgcctgcgaaagttatacggaaggttaaaaaagacactgaaaaaggagaaatttaatcatggcaaaaaagtattgatcatatcgacaagtcttcgaggaggcagcaattctgatatacttgcaaatgagtgtgcaaagggagcaaaagaagtcgggcatgatgtggaacttctttctttgaaaggaaaagatatcaaatattgtatcggttgtctatcctgtcagaggaatgggatgtgtgtactgaaggatgatgttgcagatattatggcaaaagtaaaggatgcggaggttattgtctatgcaacaccaatttattactatgagatgtgtggccagatgaaaacacttcttgatagattgaatcctttatattcgacagattattcattcagagatatttatatgattgcaactgccgctgagaatgatgaaagtgcatttgaaaaagctacaatggtctgcaaggctgggtagactgttttgaaaaggcttccttgaaaggcatggtcggtggcggtggaattgatgccgcaaatatagctgcaagccatgttgatgtgatgaaaaaagcatatgaacttggaaagaaattatgagtttgaaaagagtactgttatttagtctgtgtatattagttttatctgggcttgtaggatgtagagaaacagaaattaccgtcaaatcggaattgtgcgcccagataagggcgagtagtctagcaggtggaatgcctgtctggtaaggtctaaccaaccgccagtagcgagtcttgggtcttccacagtctgcgtcataccagcgtttatgaagaaaaaatcaaaagctcttgacttggagttaacttcaagtagtatactaatcgaaacaggaggtaaaaagatgaagaaattactgattatatattattcatggtcaaatggaaacacggaaagaattgcaaaaatgctgcagagtgagactgatagcgatattctaaaaatagataccgtagttccatattctggcagttatgatgatgtggtaaatcagggacagaatgaagtgcagcgcggatacgaacctgaaattaaaccgctggatatcaatattgcagattatgatgtcatcgcagttgggacacctacatggtggtacacaatggctccggctgtaaaaacatttctgcaccaacaggattttaccggaaagacagtagtaccttttatgacaaatggtggctggccagggcatgtaataaaggatatgaaagcagcctgcaaaggcgcaaatgtggtttgcgatatgcagatacagtttgattctacaggtggaagtaatctggagacacctcaggaacaaattaatgaatggatacagagtgtgaaaaatcttctttaaattgtggaggaagaatatgacaataaaagaagtgtcagaaaaatatggtatttcacaggataccctccgttattatgagagggttaatgtgattcctaaagttacaagaacatccggaggaattcggaattaccaggaagaagatcttagatgggttgagcttgcagtatgtatgagaaatgcaggacttcctatagaaagtctgattgaatatcaaaggctatttagggcgggagattctacaatacctgcgagacttgagttgttgaatgagcagatggatattcttcagaagcaaaaagagcagatagaggaaactatggacaggctttcttataagatatcacggtatgaagaagcagtaaaaacaggaaaactggtatggacaaaggaggaatagtacaaatggcaaagctggtagcattttattcaagagcagatgaaaattattttggcggttccatgaaatatattcagattggcaatactgagaaagctgcaaaaatgatagctgatatgacaggagcagaccttttcaaaatcgagcaaaagattccctatgccgctgattataatacctgcattgcacaggcaaaagaggataaacagacaggaaaacgaccagagatactaaatctgccacaggacatagatcaatatgacgaaatttatcttggatacccgaattactggggaaccatgccaatggctgtatatacttttctggaaagttatgattttacaggaaagaaaattcatccattctgtacgcatgaaggaagcggattgtcaaatacggagagtgatattaaaaaaagtgcaaaaggtgcagtgattgagaaaggcattgcgatacatggaagcagcgtagatcaagcgaaagatgtacttgaaagatggatacagaaatagaggttagaaaaatggaatgcaaggaaatacgtgttgatgtaagaactgcgtcaataaaagaaagtacagaagggcaacgtcagacaaaaatattatttcagattaatcatacaatgccttttactgatgaatataatcatttattaaaggaattgtttggaaataacctaggagatgggagtatgatatccccaccgcttaatggagcatgtgttggaagcgtaaagattggcaggaatgtatttatcaattctaatcttcttgcaatggcaagaggtggaataacgattgaagacaatgctatgattgctgcaaatgtacagcttatttccaataatcatgatccatatgatttgtgtactctgacttgtaagcctgttctgataagagaatatgcctgggtaggagctggagctacgatacttccgggagtatgtatcggaagacacgcaattgtgggagctggatctgtagtgacaaaggatgtaccggattatgcagtagcagttggaaatccggcaaaagtaataaaaatgcttgataaagaaaaatttcaggaggactaaaaagatggaaaatatgaagttgaataacaatttggaatgtccaatgcttggactaggaacttttatgttatcaccagcggatgcctacacaagtacattagaggcattaaaaatgggatattccctaattgatacagcaaatgcttatgtaaatgagcgtgcagttggaagagcaatcaaggatagtggaattgacagaaaaaatatatttctatcaacaaaaatatgggctagtgaatatgaaaatgagaatactgtagaagaaactctagaaagacttggtgttgattatgtggatttactttatatacaccagcctgcaggcaactggcttgccggatacagaatgcttgaaaaagcgtatagagagggcaaagcaaaatccattggtatctcgaattttgaaggaaaatatatggaagagttggaaacaaagtgggaaattgtacctcagtttattcaggtggaagcacatccatatttcacacagaaagaacttcgtgtaactttagacaaatatggaattaagcttatgagctggtatccgctgggacatggagatacagcattaatgaatgagttggtatttgcaggacttggcaaaaaatatggaaaaacacctgcacaggttattctccgttggcatactcagatgggatttgttgtaattcctggaagtaaaaatgcagaacacattaaggacaatatggatatctttgattttgcattaacagatgaagaaatggaacagattgcaaagctggacaagaatgaaagatattatcaccgcacggatgaacagcttgtacagtttgcaaactggaaaccagagtttgaaaaactgatggagaaataatctaggaaaatagtttaaagtttacatgttatgatcatgtatgaagttggaacaaaataaaagattgtgctatactattgttcaagaaaaaaactcattgacatatttcaatctatttaggaggataaacgatcatgtgtacagcagcaacttataaaacaaaagatttttactttggacgaaccctcgattatgaattctcttatggtgatcagatagtaattacaccacgtaattatgcgtttaattttcgccatgttggcgatatgaaaaatcattatgcaattattggaatggctcatgttgcagaggattatcctttgtattatgatgctatgaatgaaaaaggagtggcaatggcaggactgaattttgtcggaaatgctgtttatgccgcgattaagccagatgtggaaaatattgcacagtttgaatttattccgtggattttaagtcagtgttcttctttagttgaagttcgcgagcttcttgaacgaattaatattgttaatactcctttcagcgagcaattaccattagcacaattacactggatcatttctgatgagaatgagtcaattacggtagaatctatgtcagatggtttgcatatttatgacaatccagtaggagtgcttacgaataatccgccatttccacagcagatgtttcaactaaataattatatgtatttatctcctaaacagcccagaaatactttctgcgaaaatttggctcttgatgcatatagtagaggtatgggaggattaggtcttccgggagatctctcatcttcctcacgctttgtacgtgtagcttttacaaaggtaaatgcaatttcaggtgaatcagaggaagaaagcgttagccaattcttccacattctcggatctgtggatcagcaacgaggatgttgcgaagtagcggatggaaaatatgaaatcacattgtatacgtcgtgttgtaatgttacaaaaggtatttattattacaatacttatgaaaaccatcagatcagtgcagtagatatgcatgtagaaaatctggatagtgataaaatgatttgttatccagtaattcaaggagaacgaatcaactatcaaaataaataatgttttgaaatcagggatgaggtagaaaggaaagttccatgacaaaagatgaagtaaaaaaactcaggatgaacagtccggaatcactacagtttttaaataatgctacaaaattttataatttaatgatgatgtatcgttgtgctatacgggagatacaaactaaacttgaggttttggatgatgaattttcagttgagaacaatcgaaatcctatttcttttataaaaacaagaattaagaagcccaatagtatttacgataaactgcagaagatgggatatgaatttacaacagaaaatatacagacatatctcaatgatgtagcaggcgttcgaatagtttgtgcgtttattgacgatatttatatgatatcagatttgattacccaacaggatgatattaaagttattgaaataaaagattatataaaaaatccaaaatcgaatggttatcgaagctatcatatgattgttgaaataccagtattttttgctaagggtaaaacacctatgcgtgtagaattacagattcgaaccaatggtatggatttctgggcaacattggaacatcaacttcgctataaaaaaggaattgaagaaatgcctggctatgatgagataagtgaagaattacttcattctgcaagagctatcattgaagcagataatgaaatgcagagaataaaagacaaaattggtatgtttcatgaaatttaggcagaaaactgagcaagtaggaaggtggaatatatatgaagcaagatactttagagggcaaagcaaaaacaaaaaatggggtaaaacggctgtgtttttccatagtctgcattcttctggaagtgatttttattattactatcgtaacacgcttgaatgaatatgcagaaatcataaatttatttacaaggattttgagtggaatcttggttttgggattgtacgcatcagataagacctcttctatgaaaatgccttgggtcatcttaattctaatcttcccaattatgggtgtaggcctgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaaaggattagaggcacagattaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgctaaggctgctaatgattctgattttagtaaataccttttccactatgattatgcggcacagcaaactgggtttgttcaaccttatgcagacagccctatggataatgagcaggtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataacgcgttctttttatcatggattagttaaacatggtgttcgtgtttatgagtggactcctggtttctgtcatgcaaaaatgagtgtggcagatgactgtatggcaacttgtggaacaattaatttggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactaggacaattatttatgagattatttgctggattgctataagaatctgatgaaacgacctttcaaaaaacagttgatttagaagttaactgtttttgaaaggccgtttttgctatatctaacagtttgttgtacaaagaagattttgcatggatgaaaaaaacaaaccttgttgaggttaaattgaggttgactttgtattgtataagtatgaaataaaaaggaatcaggtgatgtacaatgaaaaagcataaaatatgtaaaatccttcttgttatactggcaatttttttatgtgtggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactgtataataaggccaatccgttgaaaccgtggaaaatgatgggtagaatgcatgataaatatttgattgcagatggaaagagatatattcttgggggaagaaatacatacaattatttcctgggtgattttccgggacataagaactatgacagagacgtgttagtggtttgcgatgaacctgagaaagaaaattcagttaaccagttgtcagagtattttgaaaccatatggaatcaggaagacagtggttattttcataacaataaaaaactggcaaatagaaaatctgtaaagaacgcagttttagagctgcagaacagctatcagaaatattttgaagagaataaggaaagaatctgcgagaccaattatacggacgaaacttttgagacagaaaagattacattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggggattgcagagaacgtttcagatttttctatcatgacaaattcagttgcgaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgattgtaattcgcagtaaagatattaataaacagttggaagagggcatgatggaatatgaaaaagtgtcccgccagatattagaaggcggaacttataatgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaagtcaaaagtgcatcggatggagcacaggcattagaagtattggataaggaatatattgatctgatcatttctgatattatgatgccggttatggatggttatgaactggtgtcggaactccgttcagcaggatatcagataccggtacttatgatcactgcgaaaggttcctttgatgatatgcgccagggatttctttcgggaagtgacgattatatggtaaaaccggtaaatgtgaatgaaatggttttaagagtcggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagggagcgtttgaaagataaccctgattttgaaatcgtaacaatgcgtggaattggatacaaggtggtgaaaaaataatggaacaaaagaaagaaaaaggattgaggatccgatcctgtctgactggtgcgatctggctggcacttgtattttcaacagtcatatctgctttattatttgcttttttgaatcatttttttaatctgccgggcagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctaatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagcccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcagatttgttatagagctgccaaagcagaaagatgagattatatagttttaagataaattagaagatgggaggatttatatgacattttatcaggagttgcagttaaatcaggcaggttctaaaaacctgttgaaaaagagtgaaacactaaaagaaaaattatatcatatgtgggtatatctggtgaaaatagctgttacaatggcattttgttttttctttgttagtattttcagcatcctatttggaaatgagaacagcattgtaggtgtagtagtcttattatgtctcatggtgtttagaaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcagatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggctatgtccgcgattttaccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctgcagagacttatggactacaaggagcggttagtcttagagtgattcaaaatgtttttggtgttgtgtttgctttagcattttgtgttatattttattggtttatgtctaaaaaaaaggaaagtgaggtgaccgtacatgcagagggaagtgaatcaggaagaaaatttgaatagaattattacggttcctaatcttctttctttttttcggctttgtctgattccggtaattatatggagttattgtgtaaagaaaaatcctctgttagctggtgaaatcttattgctgtctggtcttacggatcttgctgatggatatatcgcaagaagattccataggattagtaatttaggaaaaatacttgatccggtggctgataagctgacacaggcagcgatgttaatctgtctgtttactcgttttccgcatatgcttcttttaatcgtaataatggcaggtaaggagctgtatatggtagtcagtggatgtcttgtgatacgaaagacaggaaaagtacatggtgcagactggcatggaaagatagtaacctttttattatatggaactgcagcggtgcatattatatggttccacattacaccgatggtatcagatctgttgattggtttgtgcgctataatgatggtcatatcggtcgctctgtatattatccagaataccaggactcttaagggagagactgtataagcaattttatattgcaatgactagaaaaatatttaggagaagatagatataaacagtaagtcaaacacacaaactatggagtctttagtcggtttaataaaatcttagatagaaaataaatcattataaaaaggagctgtcggtaaataacgttttttagagctgacagcaccaaacaaaaatatcttgaacaagttacagagctttctggctctgcaacttgttcaggatatttttattttgataaatactttctgtttttggccgcaaaaaatccttgtttggattttttcagccgcatttttttctaggcagtttttccttcaaattttctcagtttttcgtgtaaaaaacgatgatatttatttatatttcttccaatagcatacagcatgaattctttatataccttatctgccgaacggtaattaaaacgccggaagttctcattttccttgatatctccaaaatgtccttccgtctgaatggaacgtgtctggcgtttcaggattccgcgttcactctggatattggcatgcgatctttctttcagttcctcccattgttcattgatcttcatgactttgttcttttcggcatctttttccgcatcatacttatacagacaacgcgctttatgttcacatccgctgcagtctgcacaaccatatacctcaaaggtctgtgtatatccatcctgctctttgctctctgtcctgagatgccgcagttcacgtccgtcatggcagatatagaactgttcatcttcaaagatccctgtcctcatgttgtaatatttactgatatcttctgaataagcgcgtgtttttcgcttttcatgatcctgcagttttatataactggatatttcattccgttttaaataaagcagatttttttcactacagtacccgctgtccgcagttacttcttccagaatactcccgaaagcattcttatgtttttcaaggaccgggatcagggtattataatcggtgcggtcgctgcttacatatccatgtacgataaaataattctctaccgcgatctgaacattatatgctggctttaactgtccgttcagcatgtaatcttctttcatacgcataaaagtcgcttccagatctgttttggaataactgtttctgtcttttcccatgatctcaaagcattctttatattccatcagtcgttttccgcattgttccagttcctcatgcagcttgttgaagtgcaggttttctttttccttttccgtaaacaaattcgattccctcgttgtctgcgatcagcgtgagattgttctggagtttccgtatttcaagcggtgaacagttatcgatctctataatacggttatttgaaagctttttatgttttacaagctttcgttttctgttcttttcgattacttcccgaactttatccatcccttcgatcacaaacatctgtgcatttcccagctcgtactttgttccataatcattctcctgcaaaaaagaattatatttttcaaaaagctggtcgatagagtccagaagtcctgccagatggtaattgatgcttccgcgccatacaaaagtataacggtttgcatttgcctctatctttgtaccgtcaataaaaagttcttttaatgtgactagcccttctttctgcagccgccgcataaactggtaattcaggtcatccaggacatcagatgtcagcttcctgtttttaaagtcataaaaagcatcacgtttcggtttttgtccgcgcgtcagccagataaaagcaaggtctctttcacacagatcaacaatacggtcaacagaacgtattccacgcatatttgcataggtaactacagcatacatcataattgggttgtacccggttcttcccttatctgaacaattggctaacaagccagaaaaatctaattcctccatcacttttttcagggtatagactggatcgtcgtcaggtaaactcaattcgaagaaactaaagttaattttctgttgcccaaactcaaaaaaatcgttataataattagttgttagcatagttacattataacatgtaacggagagaaagatggttgtcgttagccatctttttttcttttttcagataaattcagggagggtatgactcgttgtgagtcataccctccctgctttggaactatctatttcccgacagcccctttgttggcgtcaaaatcactgccagttgttatctgtataaacgtttgtgccggtatagtcaccggtgtcagcataatccgacgggaatgtttcttcctctgtaggataatcaaactctgtatcatcttccgttccatcgccactgtcgctggtatctgtatccgaagtatcgtaatcgctggaagaatcatcttcgatcacattatcctctgtattatcagttgtgctgtcgtcataagaaggatcgtaagtagtatcgcctgaagaatcagagtcagaagtatctgtactggtatcatcagagccggaatcatcgtaactgttatcttcatagtcataattgctgtcttctgtatagacagtgaagccagcatcttcggcttcgctctgagcctgtgcttcagcatcagcagcagtctccggagcttctttgaaagtctttcgtgctttggctacagtggtatccttgggaactacagcggtgatcataagcatggcacaacaaaacagtgcggtaaccccggcaattcttaattcatctttgtatctcataataataaatcctcttttttattaaatgtagtttgattttttataagtataacatgttctgagagaaatttgtattttgaattataaaaaaaggtgttatactaaaatagatggataagatttaatggagtgaggaaaatgaaaaataataaatacgaaattgatatgtgcaatggaacgttgatggacaaactgatatccttttcattgccattaatgttgtctggaatcctgcagcttctatttaatgcagtagacatcattgtggtgggaagatttaccggaagacaggcattggcagcagttggttctaccacagcgctgatcaatatttttaccaatctgtttattgggatctctctgggtgcgaacgttctggcagcacgtttttatgcttctggcaaagagaaagaaatgtcagagacagtacatacatctattaccctggcactgatcagtggacttgttatggcactggcaggagtattgcttgcaagattcgcactgaatcttatgggaactccgaatgatgtaattgaccagtctgttctttatatgaggatttattttctgggaatgcctttctttatgctttataactatggagctgccatattaagggcagtaggggataccaaaagaccattgtttttcctggtgatctcaggtatgaccaatgcagttctgaaccttgtactggttattgtgtttcatatgggagtggcaggtgtagccataggaactattgtgtctcagctgatctccagtattctggtgcttcgctgtctctacacttccaataccagttaccggctgtatttttcaaaattaggaatcaaaacacagtatctgaagcagatcttccaggtaggaataccggcaggtatccagagtacagtgatcaacctgtccaatgcccttttgcagtcttctgtaaactcttttggttctgtggcaatggcaggatatactgctgccaataatatttttggctttctctatatgtctgtcaatgcagtcacccagtcctgtatgagtttcaccagtcagaactatggagtaaagaaactgaaaagaatggacagagtacttctggactgtatgatcctttctgtcggtgtgacactgacccttggctgtggagcgtatttctttggaccggaacttctgaagatctacaccagtgatgcagatgtaatccgctgtggcgtggaagtccttgcctttactacagtaccatatttctgttgtggtattatggatctgctcccgggagccctccggggaatgggatattccggagtacctatgattctttcgattatcggtaccgtaggaaccaggattgtgtggattttcggacttttccctgcacacaggtctttgagtttcctgtttatttcctatccggtatcctggatccttacgatcctcatgcaggcagtgtgcttctgcttcgtaagaaaacatgtgcatcagtcagtgaaccgggatctggcataagcttttgttatatttaatatacaagagatgaaatttacattttataacgatgcttttataatagggcacaaaaggaggctttattatgagcacgatttttccaagggaagaaaaagcagaacagatatttgatgagattctcaaaaaccctcatgcatgcgaacgtttaaaagatacgttttttgaagcaattccatcagcggaagaaagtgaaggtgcaggaacagacattccgggaactgtttttgcggcagctctatttactgcatacgaaaataaagatctgtctgcatttatgatggcagtctgcaacagcagtgtatttgatcttctgcgaaattcgtttctaatttcgatacgttttaatgataaaggtgtggaaaatcccatatttcttacggacgaaaatggagatctgttgtctgggtcacatcagcatgcctgtgcgaaaaaatacaaaatgtttcataagctgtatgaacagcaggatgagataccggattatcatatgtacatgacggacggatttcgggaaaaacatggttataatgagaagggggagattgagacattcagaatttcagaacacacaggaattcttatgctttttgaatttccggaatctgttacactggagattaacgaagagagatcttatgccattatatggaaatatctgatgaaattacaggaacagctgccccgggcattaatgtattatggaagacgtgatgagaacggagttgaaaaaaacaccagcaaacttgtaatttttcttccgttctgccattttgaacatgaaatggaaaaaacagttgagcttgccaacggtatcggtcttggatgtcgtgaggcaatcctggcagaaataaaggctctgaaaaatgatcctaaaaacaaaacagccggggtgtgaataaaatgcagcaattaataagaaaaaaccatatggatatatcttggcatgaatatacagatgaagatggcgccaatgttcctgttacgcaggcaagtcttacagaaaaggcatccattattggacgagttgggattatgttactttcctgtggaactggtgcctggcgggtcagaagttctatgaatacacttgctgaaattatgggaattacctgtacagcagatataggtctgatgtccatagagtatacctgttttgatggtcaggatggcttttcccaatctctttgtctgaccaatacaggagtaaatacatcaaaattaaatcggctggagcattttatccaggaatttgaagttgacggaaaagatatgtcaggtgaggaattacatgtactgcttgataacatagaaaaaattcatggactgtactcaccgattgcacttggttttgcggctgctctggcctgcggcggatttactttcctgcttggtggaggccccattgaaatgttctgcgcttttataggtgcaggaattggaaattttcttcgttgtaaactgagtaaacatcattttactttatttttgtgtattgtgtcttctgtatcacttgcatgtcttgtttatgcgggacttctcaaaattggtgagatgctgtttgggatttccatccagcacgaggcagggtatatctgtgcgatgttgtttattatcctgggttttccatttattaccagtggaattgaccttgccaaattggatatgcggtccgggacagagcgactgatgtatgcattgattgtgattttggtagcaaccatggcggcctggcttatggcattaatccttcatttgtagccagttgatttcctgaaaatatctttaccagttggagcttggattttacttcgtcttattacaagtttttgtggggtatttggattttcaattatgtttaacagcccggtccggctggctgcaacagcagcaggaataggtgccattgcaaatactcttcgactggagatggttgatatgactgccataccgcctgcaggagctgcttttgtaggtgcactgacagcaggaatcctggcatcgctgattaaaagtaaagtaggatatccaagaatttccctgacagagttccatctattgtgataatggttccgggtatgtatctttacagagggttttataatctgggaatcatgtccctaggtccggcagcgtcctggtttgcatcagcgatactgattattgccgcattgccgctgggactgatatttgcaaggatactgacagatgaaacatttcggtactgtacataaacaaaaacaggtctgattgctcaaataaacagatggattataaaaaggtactgaaaacctcctgatggtggtttccggtaccttttttgtcagagagaaaaatagaataacaggatatacaacagttgcttttttaacgtaaaatgttttaatgggatctgctccattgaaatcttaaacttttttaatattgctgaacaaaagtgtgcgtatttttgtattacttcggatcaggattctacatacgatatgcttgctacactgttttggatccgggtattcttcaatggaaagcataagcagactgccatttagtgttctcaagatagataagtgtctgatcaatcacgtatgtgagacgagagtgaaaattcttgtggatcatataataaaattatcaaaagccctaaatatgagggtacttgctgaaggtgttgaaacaacagaacaactggatgtattacgaaaaatcaagtgcgatgagatacagggattttattatgcacgaccaatgccagaagctcagtttatagaatatgtaagaaaaagcgataaccacaagaaactctagcaaagaaacaccgaaaagacgacatacaaaaaagtaaaagtagataagaggttttacggaaaattgaaactgtttgttaagataagatatccataacaagtctatgttgtccgttatcatttcaatgaaatgtcatgtgagtaacaaatctggagttgacgaggaggtgattttatgaaaaaatttatgcccattatctatgttatagcattcgttattggtattatcttcatcgtaacagcagatacaggattgattacaagttattatcctgctttgattgcaggcataatcattagctgctttgcgagagtgttccttgctatctacttatatgtttggcataagcaatctaagtgagttatgtcaattccagtttgtagaggacttaatgaatccttgtaatattgggcgttgcatgaatgttaatttgcgttgcttgatgtattgagggctaatcagtatactagttttatcaaacgaaaagagtagctagagatgattggtaaaacgatactttacactggtaggtgcagaaaaaatgcgacagtatcggagagttttgattgccaggaagaagaaaggatagatttattgccggaagtcacagataaaaggtggcgtccggctttttttcatgccctatatttattatcaataaagttatcaatgttttgtaacttagaatatgatatgtatgtaatgaaaatattaattacaaatagtaattcgttttatatcatgaaaatttagcacttttatgagaaaaatatgttaagaagtatgggatatttgtggataaaagaacatacgtatggtatactaaatcaataatgttgttattttaaggagggggatagatttggataagatatatgctgtaatcgacttaaaatcattttatgcatcagtggaatgtgtggaaagaggcttagatcctctcacaacgaatcttgttgttgccgataagagccgtactgaaaagaccatatgtcttgccgtttctccttctttaaaaaaatatggtattccaggacgtcctcgcttatttgaagtaatacagaaagtgaagaggattaataaagaaagacaggaaactgctccggggcataaattcataggacaatcttttcattcagataaattaagtgatccttcggttgccctggcatatattacagcacctccgaggatgtcattgtatatgaaatatagtacacaaatatatcagatctaccttcggtattttgctccagaagatattcatgtatattcgattgatgaggtttttattgatttgacaggatacttaacaaattatcagatgggggcaaaagaattaatttccaaagtgatacaggatgtattaaaagaaacagggatcacagctactgcagggattggtacgaatctatatcttgcaaagattgcaatggacattatggcaaagcatgtgccagcagatgagtatggggtgagaattgcttatcagaaacagggatcacagctactgcagggattggtacgaatctatatcttgcaaagattgcaatggacattatggcaaagcatgtgccagcagatgagtatggggtgagaattgcttatcttgatgagataacatatcgaaagaaattatgggaacatcagccgattacagatttctggagagtagggaaaggctatgccaaaaagcttgctgcatatcagatttacacgatgggagacattgccagatgctctgttggcaaagaaaaggaatatcataatgaggaattactttataaactatttggcattaatgctgagttattgattgaccatgcctggggatatgaaccttgtacgattgcagatataaaagtatataaaccagaagcaaaaagtatcggttccggacaggtattatcttctgcttattcatcagaaaaagcaaaaattgcagttttagaaatggcagaacagattgcatttgatctttttgaacagaagcttgtttcaaagcaatttgtcctcacaataggttatgatagggataatctacaaggacaggaatacagtggggaggttgcaacagatcgttatggaagaaaaatccccaaacacgcacatggtacgattaatctggatataccaacttcttcactaaaagaaattacaactgctgtttctagtctttacgacaggataattgataaggaactccttatccggcggctcacattatctgctgctaaagttatgcccaaagaaggacaggtatatcagcagttagatttgtttactgattatgaagcattaaagaaagaacaggaaaaggaacgtagattacaaaaatctattcttgatattaagaaaaaatacggaaaaaatgcagttttgcgagggttaagttacgaagaaggtgcaacaacaagaacaagaaatggacagataggagggcataaagcataatgggaaagtatgacgatatcatcaatcttccgcatcatgtatcaaaaaaacactcccagatgcctattgcagacagagcagctcagtttgctccatttgcagctttaactggatatggagaacagattaaagaaactgctagaactacggaagaatttcatcaggtatcaggacgagaaaaagaagagatagatcagaaattacagatattacagcaaacccaatataaacatcctctaatttccatatattattttgcaccagatacccgaaaacaaggtggacattataataaaacaacaggatgtgtaaaaaagatagatgtaataaatgagaagcttatgatgatagatggaaatgaaattgcatttaaacatataaaagaaatacagggtgatttttttctttcaattatggaaagtgaaaacattacatgaagccagaatatttttcaaatacactctaatccgaacaaatgccagctttatgtggataaaaatgaaaatgaataaatcagtattacaaagggggagcatgacattagtaaatatcgattatcacagctttttcaggaaggtaatccagagaatctgacagacaaacagaaagaagttttaaagatatggaacaatctgagtacaaatgagcaggaaacagtaatgtcaatgcttcgtggacttcgaaagtagaagaacagttcgagtatatgtatcggctgttcttttttgattttcgggtgttaaaacggtaatgtttttcttgtatacagtagagaaccatagtataataaaaccagtttttttgcaaaagtttaaaaataataaggaaatcggcaaaccagatgaaagtctgggacgcaaagctacagggcctgtaaaatggcagccagttacatgaaatgaggtgcactgtctgtttggcagtgcttttttatggtagagcacttgaataagtaatacagaagctgtttggaaaaatattgtgaaaaatagcggggaggttattgataattaatgaatgtaaaattaaaatctggaagtaagcaagcaattgtagcctagaggaggggagaaagatgaagaagtgcaaattagtacagaatataatgaatttcaaattttgttacattatattttgcacaattatatgttttattgttttatccgttcctacatttgccaaagaaaactctgacaatgttatccgggtaggatcttttgaagaaacttataataccgtcaatgaaaagggggaaagaagcggctatggttatgagtatcttcaagatattgcaggttatgcaggatggacatataaatacataacaagtgattggaaaaactgctttacacagttggaaaatggagagattgatattcttggcggtatttcctatacagacgaacgtgctgaaaatatgcttttttccgatatgcctatgggggaagagaaatattacatctatacggatgcatccaatatggatcttacagcaggaaatctggattcttttgagggaaaaaatattggtgtgtttaaagatcatataccggaggatctgcttaacgaatgggagttaaagtatggtctgcatacgcagcatgtcaatgcttctaataccgcagaagttatggacaaactgtcgaaacatgaaattgactgcttcgtttcagtagaagaatcccgttgggaagaatctgatatttcgcctgttacaagtattggagagacagaaatctattttgccataaatcccaaacgtccggatatcaaagaagcactggatagtgctatgcgcaggatcaaggatgacaatccattttacactgatgatctctacaggcgttatctttctgcacagagcagctcatttctttcaaaagaagaaagggagtggatcgggcagcatggagcaatcaggatagggtatctgaatcaggatggaggtatcagtagtgtagatccatcaacaggcaaactgacaggtgttatcacagattatgtggatcttgcagaaaattgtctgcaaggccagactctggaatttgaattaaaggggtatgatacaagaagtgaactgcttcaggcattgcaggatggaaaaatagacctgatttttcatacaaaccagaatccatactttgcagaaacaaaaggagttgctttgtcggatacgctattgactctcaatatggcagcaattacggcaaaggatttttttgatgaaaataaagagaatacagttgccgttgaaaaagatgatttttcattgaaggcatatctttcatacaattatccaaaatgggagattatagaatatgggacatcagatgcagcagtaaaagcgatgcagaaaggggaggtagattgcattgtaagcagttcaggtactgtttctgactatttgaaaaataataagcttcatagtgttttcctgacaaaagaagccgatgttccatttgctgttcggcagggagaaccggttcttttgtccattctgaataaaacactgacatctatgcctacagctcaattttcaggtgcggtagtttcgtataatgcttctttacgaaaagttacagcgaaggattttattcaagataatttactggctgtctcactcatagttggaatctttatttttgttgtcctgtgtataattcttgattctttgaaaaaatcaaaacgtgcggaagaaaaatccaagaagtctgctgagcaggcattgaagctgaatcaggagcttgaagaaaaacagcaggaattacaaaatgcacttgtagaagcacagagtgccaataaggctaagacttcctttttaaataacatgtctcatgacatcaggacaccgatcaatggcattatgggcatgcttacaattcttgaaaaaagcggaaatgatggtgagcgggcaaaagattgcctgaataaaataaatgagtcttcgaaactgctattatcattggtaaatgatgtcttggatatggcaaagttagaatcggataccgtggtttttagtgatgaatccatcaatctggatcaggtatgtcaggaaatcacggagtcactatcttttcaggcagaagaaaaaggacttcatgttataggagaacatgatgattacagtggtatatatgtttggagcaatgcagttcatctgaaaaaagtattgatgaatctgtttacaaacagtatgaagtacaataaggtgaatggttctatttacatgagtatgagaacgattgaaagatcagaagatcacatgacatgtgaatttaaaataagagataatgggattggaatgtccgaagaatttataaaaaatgaattgtttactccatttgtacaggcagataattccccacgttctgattataatgggacaggtctgggaatgcctattgtgaaacaacttgtagaaaagatgggcggaaccataacagttgaaagcaagcttggtgaaggaagctgttttactgtaatacttccatttaaaattgatacgaatgcacggctggaagaaaaagaagatttcaatgcagatatatcaggtgtccggatattattggttgaagataatgagctgaatgcggaaatagcagaatttatgctgacggaaaatggggctaaagtagaaacagtgaaaaatgggttagaagctgttcagcactttgaagcctgcgaatcaggaagatacgatgttattttaatggatgtcatgatgccggtgatggatgggcttactgccacaaaaacaataagatccttggaacggcaggatgcaaaaacaatccctatcattgctatgactgcaaatgcatttagggaagatgtagaaaagtgtatggaagcaggaatgaacgcacatcttgcaaagccgttggatgataaaacaatcaagcagactatatgcgaagaattgagaagcagtagggacaggtgaaaatttattaaaccaggaggttgacaaggagatgtatagagaaatatatttgacagacagaaagaaaggaaatttaatatgatttcgagtgcaaagaaatatatggcaatgttactggattttgtatgtgtgtgtatgatattttctccccagactgcatatgcggccgaggacagttcgcagcatgaaactgtcaaagtcggtttctttgccatagatggataccatatgatggatgaagagggaaaccgcagcggttatggatatgatttccttcggctgatggcccgttattgggatgtagattacgaatatgtcggatacgatcagagctgggatgatatgcagcagatgcttgaatatggcgagatcgacatggtaacatctgcccgcaaaacaccggacagagaagaaaagtttgatttttcacgtccaatcggaaccaattatgggatgttgaccgtccgcagtgacaacagcacgattgtggacggcaattacagcacttacaacggtatgcgtgtggcgcttttgaacggaaacacccggaataaagagtttgcggattttgcagacaacaaaggatttacatatgttccatcttattttgatacgaccgcagaaatggaggaagcccttcagagcgaaaaagttgatgcgattgttaccagttctctgagaaaaacaaacaatgagcgaatcgtggataaatttggcagcagcgatttctatgtcattgttaaaaagggcaatacagaattgctgaatgagatcaattatgcgatcgatcagatgaatgcggttgagggtgactggaaaacgacgctttacaataaaaattatgaaagcatagaaactaagaatctggaatatacggagcaagaaaaaagtattattgcacaatattccaaggacaacccaattcgtgttctgtgtgatccgacccgttatccatattcttataatgaaaatggtgagatgaaggggattatcccggattacttccggaaaattgcagactatgccgggatttcctatgagtttcttacacctgccaccagagatgagtatattgcttatcagaaaaataaggaagccacagatatgagtatcgatgcacgcctggaaacagataactatgctgagacgaaaaaatgggggcttactgcacctttcattacaatgcagctggcaagggtgacacggcgtgactttgatggaaaaatcaatgttgttactacggttgaccagacagcatcaaattcaattgcagatgcaatggcacccggcgcagaaaaactgatgtgcagtacccgacaggaaatgatggaggctgtccgtaagggaaaagccgatgctgccttcgtctactattatatggcactggcgtttgtgaatagtgacaccacaggcaccctgacatatactttgctggaacagcctacatacacctaccgcatggtaatatcatcaacagagaatcatgcactggctggcatcctgacgaaagcaatgtatgccatgccaaaaaaacttgtcgaagatctagcagcacggtataccacatacaaagcaacagatctgacatttgttgactggatccgtctgcatcctgttgttactgtttgggttcttcttattttcggatggttgctgactactatggctgtgatagcaatgcgtctcagtgcaagaaaaaaagctcagaaggcagcccaggagacggctgaggaaatggcggaactggcagagcatgcgcaggctacaaacaaggcaaaaacagcatttctgtcacatatgtcccatgatatgagaacaccgatgaatgcaatcatgggatttaccagtattgcaatgaaaaataatccgtcagacgaagtgaaaaattgtctggaaaagattgatgaaagttcagagtatttactgtcgctgatcaatgatgtattagatctgactcgcgtggaaagtggaaaagtgaaatacaatccggtaccggcagatttgaaaagtatcacagattctgcactggatattacaaaaggctttcttacgaacagggatatcagctttaagatccagcgtgaagaagcaaagatcccaaatgtacttgtggatcctgtacgtctgcgagatgtgctggttaatattctgagcaatgccgtgaagttcactccggatggagggacgattacatttgaagcccggtgtcaggaaaagggcggggatggatatataaatatgcattaccgcatttcggatactggtattggcatgagtgaggaatttacaaaagaagtttttgagaaatttgcacaggaagattccgatgtgagaacgcagtaccatggagttggactagggatggctatcgtaaagaagtatgtagatatggtgggtggaaccatttccgtgcaaagcaaaaagcatgagggaaccacttttactgtggatattcctctggaaattacagataaggaatgtaataagtcagacacaggtttttctgaaaaggtgaatcttacaggtgtgaaagtccttcttgcagaggataatgagctgaatgcagaaattgcgaccgtgcagctggaagagtttggaatgaatgtagaaagagctgtagatggaaagaatgctgttgagattttcagaaatcatccggaaggcacatttgatgtaatcctgatggatatcatgatgcctgaaatgaacggttatgaagcggcaaaagcaatcagagcgatgaatgacagaccggatggaaaaaacattcctattatagcaatgacagccaattcatttgctgaagatgttcaggcatcactggatgcaggaatgaatacacatttgtcaaagccgattgtgattgaggaagttataaaaacgattttaaggtatgttcataatgattagcagaagttcatgaattagtggaatacaattgacaggagggctaaaagatgacaatgcaggagtgctataaagctatcggaggaaactatgaggctgttttgggacgccttcacaacgaagcactgattccgagatttacattaaagttccttgaagaccagagttatctacagttaaaacaggcattggaaaataaaaattatgaagatgctttccgcagtgcgcacacattgaaaggggtgtgtcagaatctttcctttgatcgtctgtatgaggttagtaatgagttgacagaacttttgagagatagaaccggagagaagccggggataccggaagcaatggaaaaagtaacagaagtatatgagatgacgattgaagaaataaagaagggtttgtcgcattaagtgatgcgacacgactttctgtcttggatcaagtgcttggaacatcataaaaaatgagtggatgaaggtaataaaaaatatggataaaagacaaaaaattctgattgtagatgattcaaaattaaacagagagatattgaaagagattctcggagaaacttataattatctggaagctgaaaatggaaatcaggcaatccagatgataggagaaaatattggaattaatctgatgcttttagatatcaatatgccacagatgaatggttttgaagtcttggagataatgaaaagaagccagtgtattgctgaaactcccgtaatcatgatatcttctgaagatgctgttaatactatgcgtaaggcatatgagttgggaatcacagattatatcacacgaccgtttgattctgtgattgtaaagaaaagagttcagaataccttgggtctctatatgaaccaaaagcatctgattaatgtggtttatgatcaggtttacgaaaaagaagaaaataataatatcatgatccagattatgagtaatatattgggatcccgtaacagcgagagcagagagcacatcctgcatattaaaacagcaacggagatgatgctgagacaactggtaaaagtaacagatgcttatcctttgacagaggcagatattgctttgattacaactgcttcttcccttcatgatattggtaagattcgtattccggaagaaatattgaacaaaccgggcagacttaccgatgaagaatttaagattatggaaacccatagtgagcttggcgcagctataattaaggatatggacttttcacaaggtcatccactggtacataccgcatgggaaatctgcaggtggcaccatgaaagatgggatggaaagggctatccggatggattgaaaggtgaagaaataccaatttccgcacaggtggtatcgattgttgatgtttatgatgcacttacaagtgaaagatgctataagaaagcatttgagcatgatacagcgattcaaatgatcatggatggacaatgcggacaatttaatcccattcttcttaagtgtctgaaagaactgagtcttcagctttcaaaaatgcttaataaagagatggacgataataaatattctcatgaaatacagagactttcgaatgaaatactcagtgataaatccttaccgaaccagatttattcacagagtcttgtcaaagtcatgcaggaaaaaatcgatttcttcaaatcaaacagtggcacgaattcgattgattacaatgtggtttcaggtcagctcactatattaaacggaaaacagcaggtattatgtcagagaaataatccgaaatttgatctgttcaaagaatttggggtaattgaagaagacgttcaatatattcgggttttgttacaccagacatctgtacaaaataaagaaatctctgtgcagataaaagcgacggtggaaaataaaagtcagatgtataaaatgaaattacatacgctgtggtcgcctatgaagaaagacgtatgcataggaattatcgggtattttgacattataaaataaacatgaagcttattaatcatagagtgtatggattcatttccatatgctcttgtttttttaaaaatatacttctggatttaaaactaaatacttgcaaaataggtatctaataattttgcatcattacaggtacaatagaatcatgtaatgatggaaatgaggtgtatttacttgcatatagagaagtatgttgcgaagaatataatttctttgtgtgaaaagcgtgacatcagcaaataccgattatcgcagttgtccgggatttctcagtcttcgcttagcaggattatgacgcaggaaagtctgccgtcattgattactcttgaaaaaatatgtgtagctttgggagtaactttatcacaatttttcagagaagaaaatccagtagatttaacggaatcacaaaaagaaatacttaaaatatgggacaatttaagcacgaaagaacaggagacagttttagcgatgcttagaggtcttcagaaatgaagaaacagttcaaacatatatgtttggctgtttctttttttgtgcagataaagagagagttagatttaattttaattatataaaaattgaaatatttataaagaagttaacaagaaagacaatatgggaaatactagaaataactaatgcttatgagatgaataaatatctattttaataaaaaaacaaataatatatattatataattactactatttaaaaaataaatattatgttaaaatatttatggcgttctgcaaacacagaacgtcttttttttttgcaaaaaaagtaaaatatcctgttaaggggcaaaactgacagcctctatatagaaagaaaaaccttgaaagtctgagagattaggctttcggggtttttttattatctagctgacatagagtggaaaccttaatttatgcgatatttccaaaataattctccctaaacataacaaggcaaaataaaaaaagagagaatcaaccaatgaaagaaaacgagaaattagaagcaactaacacagaattagtggcagaaatactctaattatacagcatcatcaccgaaaatgatagcaatatatcaatgcaggagaaagagagtatataaaatgtgcgataataaacttgacccacgtttctatccagaagtatatcaggcggtggcaggaaaagattacacagtatacgcctatatgaacgatggcggcgtaaggaaatttgatgttaagccctgataaagaaaggcggcgttttcaagaaaattgaggataaagagatatttaaaaatacactgacagttttaaacggtacagttgcgtgggatatagccggaaaccggaatatatataagtgtatagatattgatcctatgacaatcttcaaatcgccagcagtgccagatttccctgaaatttagaggctttagagtaataagaaagggagtgtgagatatggactggaatcttaaaataacagacatgataggagatatgccagaacactctactgtaatcgtaaattttgttgcagcgattagacatcagttgaagaatagtacatgctatgtatattcagataatattcaatatcatttccaggatagtcagggcaacaacaagattattattcctgatgcatctataaactgccgtacaaaatcaagacatggaaacacctttacggatgcaccacgttttgttatggaagttctgtcaccatcaacagaaaagtatgatagaacagagaaaatgcaactattttgagaaacgaagtgggcgataatataaataagcacgcatatagaacagatagaaaaatatccatagaagtttttaatagtgtaatctctaaaactaacataaaaaaatatacagattttttatccggaattattgacgtataaataacttcatggtattttatttttgataaaaatggaaattatttaaaggcaaatctgctgaaaggcagggacgcaaagttagaaggggctaaagtcagaaagattgaccaggtcagccagttgccactgtttccatatcatatatggaaaagatgtgaaaacagaagagatttcgataaaatttatcctcttatagcaggaagactccgacctctaaggtgggagatgaattgcgtctgctacctacttgatagagcatcctgattatagtatagtatctttagtcggataataaaaaattgagataataacgcacatttagtattcttactatattaccatcttgcgcttgtgttcaagtatcacaggtgggttttcgaggaaaaggaagtggcatggtggcaaacagagcatataaattcagaatatacccgaatgatgaacagaagattttgtttgctaagacttttggctgcgtgagaatggtatacaatcattggcttgatagaaaaatccggcagtatgaggagaacaagacaaacgtaacatataccatttgtgcaaaagaaatggctgcaatgaagaaaacagaagaatacaggtttttaaaggaagcagatagtatcgcattacaacaatcgctcaggcatcttgatacggcatttcagaactttttcaaacagccgaaaaccggtttcccaagattcaaatcaaaaaagcggaataaaaacagctattccacgctctgcatcaatgagaacataactctgtctaatggatatttgagattacctaagattggacaaatacggttaaaacagcacaggtctgttccagatgaatacagactgaaatctgtaacagtaagtcagacaccaagcggaaaatactatgcaagtattctttttgagtatgaagatcaagtacaggaaaaggagctgcaaaagtttttaggtttagatttttccatgcatgaattatatcgtgacagcaatggtaaagaacctgcctatccggggtattacaggaatgtagagaaaaaattagcgagagaacaacgtaagctttccagaatgcagaaaggttcaaacaatcgcaataagcagaggcttaaggtggcaaaacttcacgaaaaggtttccaatcaacgaaaagactttctgcataagcagtcaagacagataaccaatgcctatgattgcgtatgtatagaagatctggatatgaaagcaatgtcgcggtcactaaattttgggaaatctgtttcggataacggctggggaatgttcacaacatttttgagatacaaactggaggagcagggtaagaaacttgtgaaggtggatagattttttgcaagcagccagacctgttctgtttgtggttacaaaaatgcaaaaacaaaagatcttgcgttaagagagtgggattgtccacagtgtgggaaccatcatgacagagatgtaaatgcggcagtaaatatcagaaatgagggaatgcggctggtaaatgcatgaccttaacacaatataacacaaccgtgggacacacggggatagctcgcttatgcttagcacagtagtgttatcgaacgagaaccaaacttgccgaggttgggaagcccccacctctacaggtgggggaggatgtcacacgatatgaatgtgtgattttaaagaaatgtagcaagggcactggcggatttagacagatgccctttttgtatgcaaaaaatgagtaagaaaactggcagggacaggttttctgtatacagataaaagcaggatgaagaaggtataaaacgaagagaggatttttataaaatgcgaaattatgaagacaaaatatattctttaaatgagactgtaacgggacagacacaagccatgtcacaggccgtacagaaagcactggaaaataatggtggggtaggcataatgacaggatattatgaccaaaacctgtctgttttatctgtgagcaatctgctgttacatagtacaggatatacattcgactcttttatggagcagacaaaaggctcattgaaaaatttcttttatggcgatgatatggatatactggattatgaccgttttttgcagtttcacggaacaggggaagcacagatccttgcagcagacggtacagtgaataatgtacgggctttgtaaagaggatgcgacagatgaggcgggcagacagatctgggttatgtccgtacaggtcaactgggatcatgtaaatttggcactgctcaatgaggctatctattccggcttctggtattttgactgtgacgaaaacagtgagattgtgaatgcaaactggagtcatgaattccgaaaaatgctgggctatcatgacactctggactttccgaataaactggaatcctggtcagatcttctgcatccacaggataaagaaagagtaatggtgcagcttcaggcggcaattaaggataagacgaaccagataaaataccaggtagagtatcgtatgagaatgaaggataatcaataccagtggtttcgggcatcggcagaagtaatacgccgtctggatggttctgccagcaggattgccgggatttttattaacattgatgcggagaaaaaagaaatcatgcaggcacaaaaatctgctgctttccaccgggcttttacgaaagcagatttgtgcgagtattatgtgaatctggaagcgaatacttttgatacctttaaggttgaaccgtccctgatgaccgtctttgaacagagtcatacgtgggatgaattgatccggcattttgtggattcttatgttgtggagacagataagaaggcggtatcctctttttacgaccgtggttatattgcagaaaggctgaagggtctggaaaccgaattggctttggagtgccgtatcactctgaatggagaagaacgatgggtccgaaatgtggtcatacgtggcgaaatagaggattcagaatatgccatgatctttctgcgtgatatcacagagacaaaggtagagagcgcacggcatctgcagatggcagcggataatgcttacatggagcagctgattcagagtattgtgcgtctggttgaccgctttgttgtctgtgatctggaaaatgacagatatgaattctacaatctgaatggacagatgatatataaacctctgggattttatcatgattttcagatgcaggttcttgaaaaatataagacactggaaccattggaagctatagatatcctgatagccccggataatattcggaaaaaactgaaaagtgaaaatgatatttataagtttgagtattgcagcctggatgaaaagacttataaaatcgcttcttatattcccttggaatggaagaatggaaagctggaaaaggtattgctggcatccatggatgtgacacaggagaagaaagcagagattgaatcccgtcaggcactgaaagaggcttaccggtccgcagaaaatgcaaatcgtgcgaaaacagaattcctttctaatatgtcccatgatatccggacaccaatgaatgcgattgtgggcctgacggcaatcgcaggagcaaatgttgagagccaggacagagtcattgaatgcctcggcaagatcacagaatcaagccgccatctgctggggctgatcaatgaagtattggatatggcatgtattgaaagtggaaaaatgacactggcacaggaagatttcaatctgtcagagctggtagataatcttattacacttacaaaaccggtgcttgatgaacataaacataattttgatatacacattaatcacattgaacatgaggatgtctgtggtgacagcttgaggattcagcaggtatttgtgaatctgatgagtaatgcgatcaagtatacaccggatggcgggaatattattttttccatagaggaaaagccaaatggattttcagaacttggatgctatgaatttacgattgaggataatgggatcggtatgtcaccagaattccagaaaatcatgtttgatccgttcagccgcgcggatgaccaccggacaaccagagtccagggaactggtcttggaatggcaatcagcagaaatattgtgaacctgatgaatggcactattaaagtggacagtaccttgcacaagggaactaaaatcacagtaacaatttatctggagcttcaggaaaaagaaaaagaacaggacagagatctgatgaatctgccggttctggttgtggatgatgataggacatgctgtaaaagtacagttgcaacattaaaggaaatcggtattatgggtgaatgggttctttctggcagggaagccgttgagtgctgttatgcacggcatgagttgaaagatgattattttgctgttattttagactggaagatgccggatatggatggcatagaaacagccagacagatccggaaacggatagggaaagaaatcaccatcattgtactgacatcttatgaattcagcgagattgaagaagaagcaaaggcggcgggcatagatgcttttattgcaaaaccgctgttccgttcccggctgacggctacactgcggcagtttacttcaggaagaaaagaaaaaacagcaagaaattatttggagaaattgtcagaatcagactacacgggaaaaaggattctgctagttgaggataatgagttgaacagagaaattgctggtgaaattttgcagatgacaggtacaaaagtggaaacggcagaaaatgggaaaattgcagttgagaaagtggaagcttctccgaaaggttcgtatgatcttatttttatggatatccaaatgcctgttatgaatggttatgaggcaacagcggcaatcaggagtcttccgggtgcaaagggaaaactgcctattgttgccatgactgccaatgcttttgcagaagacgtacagcttgccaaaaatacaggtatgaatggacatatcgcaaaacctctggatatgaataagctgaatgatgtcctgaaaaactggctgtaattgattcctaagtgtgtggaaaaatcctggaaaagtagagagagagagataatagcatcaatatttttgcataatttgaaaagctgtaataggataatcggcaaatcagatgaaaatctgagatggaattattgaattaatgattttatcaggaaagaatgaggaaaatacgagtatggaaaaggcaaaacaatgtctgatagcagtactgttaggtgtatttttaacaactactgttttatccggctgtggacagtctaaaaaagaagtatcccaaaaagataatcatcttaccgtgtatctatgggaaaatcgtttaatgaaaaatattgctccatatatccagaagcagtttccagatcaggatatcgagtttattaccggtaacaatgataccgatttatacagctattttgaagaacatggggaactgccggatatcataacggtacgtcgattttcgggggcagatgcacaggatctacagccgtatcttatggatttttgttcatatgatgttgtctctaagtattattcctatgcattgcagtattataaaaattcagaagatgagattcagtggctacctatctgcggaatcccgcagacgctcattgccaacaagacattgtttgatcagtatggaatcaagattccgaaaaattataaggaatatgcacaggcttgccagcaattttatgataatggtataaaaccttatatacttgatcttgcagaagactggtctactcaagaagtgattcaggcaggagcaattggtgagttcacaagtcttgatggaatcaaatggagaagctcagcagaaagttcggcagataatataaagtttgatgctgcattgtggaaacgtatcctttcacaaaccagtacgtttttaaaagactcacattttacgaaagatgacatcagcgttgatattactactgcaacagaaacatttcttgagggaaaagcagcaatgtttcatggatatccggcacttatacaggaattccagaaacagatggatgcagaattgatccgtattccttttttctcacagacttcagatgaggcttttataaatatgactccgtccttaaacattgcatttaacaaagatttagaaaaaaatcctgagaaattagatatagcactagatgtactggactgtatgatttcagaagaagggcaaaagcgtattgcggatggaagtggtgtgatctcattgaatactgatgttccgacaatgatgaaagatgtgtctggactggaaaaggaaattcaagataattctgtttatatcagatattccgctcaaaagtcttttgcagccagcctgaaagttgttcatggattgctgtcaggagaaatggatgaagaaaaggcttatgatactttgtgtagtgtaatgaatagtaaagctacaggagaaaaaacgactgtgaattttgagcatgagtattctatttcactgaatgataaaaatggtcgtgatgcggcatcatctatactaactacggttagaaatgagaataatatacagttagctctggcaccatactattatttcacttcttctatttatgaaggcgaatgtagcagtaatcgtgttgctctaatgacagcaaagaattcggatacgccattataccttgcaaagataaatggtaaacaggtatatgaacttgtgggaaattatcttgcggattttgattcggatttttatgtaactaataaatatgaattaccgatagcatctggtatgaaaattattgttaaagataaagaaaatggattctcattaaaaagcatagcagttaatgagaaaaaaatagataaagagaagaagtattccattctgcttacggatattactatgtccattttgaaaaaattatatccagaatgtgagattacccaacttaaggatacaacgttatcaagtgcatgggctgcagctatgtcaaaagggcagcagccgtcagcaccggaagactatatagaggttgaaaaataaaagtgcagataagacaaaaggtaataaaaagaaagagaattataataccaatgcttataatcctgctcattttttcaagcatattatttatgaagcttcttttgaacaggatgaacaggtatattgatgaaaatggaaaaagcagcatgggagctgttgttgaacagatacagcaaacctatgagcttcaggtaaatggatattatagccagttacatctagttgaagattatattcttaaggagaaagaagtatcgcctgaaacagatgcaaatcaaaacttttttgaggcatgggaaaaagaagctggaagcaggctagtatttcttcaggaaaatggaaaagcaatgacagcagatggaacgaagatgcggattgacataccaggtaagcttttgctggctttaaggaatggccataatattgcaaagctggttgcctggaattatgaagaaacacaaagtggaggttatctggttgcaattccatgtcaggaatatcatatgaatggggaagtttatacagcagttggaaccgtgtatgatcattcaaaattagattccatgttaaaactgaagagttataatgagaatgcgtatctctttctgttagatgaggaagaaaatattacctatacgaaccaaagtgaagataaattttttcgaaattattcattgttgaagcatttaaaggcagataaggctataacagaaaaagaggctgctttgctccaaaaaaagatggataaaaaagaacagggactagagcgtgtttgaaaaataaaagttgcacaaaacatatattcccacgccctttttcatgataaaataaagaaaaaaggggagtttattatgttgagacgatatgaattaacagatgaagaatggaatcaaattgtttctctactgccacctgaaaattctggcaaacaaggacgaccatccaagtgtaaccgtaccattcttaacggaattgtctggattgcccgcagtggagcaccttggcgtgaccttccagaacgctatggcccttggcaaactgtctattctcgctttcgcaagtggatggaagacggtatccttgataatatctttcgtgttttaagccttgatgcagaattaagcgaattatcaatagatgcctccattgtccaggctcatcaacatagtgcaggtgcaaaaaaagggggccatccaacgaaatcggacacagtcgcggtggagcaagtacaaaaatccatgccattgtagatgcttatggttatcctgtttatgttatgctcagtgagggacagcgtaatgatattaattacgccatccctttgctagaacaagttgacataaaggaaagtgatatactggctgaccgcggatatgatagcaataaattaatggactatatctatgcccatggtggtgagccaaccataccttccagaaaaggggctaaatttgaccgttactgtgactggcatctttacaaagaaagacatttagtggaaaactattttctcaagttaaaagcattccgtcgaatagccacgcgttatgataaattagcatccacttttgcagcatttatatgcatcgcctcaatattaatttggttaaaatgaacaacttaaaatgtttttcaaacacgctctagagcttcttggaaaagataagcctttctatctggggtactgtcctatagaaagtaataactccatgttgatctgtattgtgaaaaaaagtgttgttgataatgtgatgagaaattaccagaaaacagtgctttttacaacaatactgatgggaagttttatcattttgctctttgccggattgttttacagtatttcaaaacttaatattgcagaccaaaaagcagaatgtgaaaaaagaaatagtgagcttcaattacagacaatgaaggaaatggaagcggcaaataaaaaactgaaaaaggcaaagaatattgcaacagaagctctgcagacagctgaaaatgcaaataaggcgaaaacagattttctgtcgaatatgtcacatgatattcgtacacctatgaatgcaatcattggtattacgtcactgatcagacatgatgcaggtgataaggcgaaagtaacagagtatgcagataaaatagatacatcatcacagcttttgttaggaattattaatgatgttttggatatgagcaaaattgaagccgggaaaactgtttttaaatacacggatttttctattctggattttatacaggaaattgatcatatgtttaagatacaggcagaagaaaaaaatcagacccttcagtttacaaaagaaaacatcctgcacgagtgggtgaatggggatcgggtgcatctgatgcagattttcagtaacttgctttctaatgcagtgaagtacacacagaagggcggaacaattgaagtagaaagtgaactggggcagggaagttgttttgaagttattatgaatctgaaagttgtagaaaaccgatcagtttctctggagccacaggcagaaaaagaggagttggataaaaatatcctaaaaggaatgcgattcctgtgtgcagaagataatgagctgaatgcagaaattttgatagaactattaaagattgagggggcagagtgtactatctgtgaaaatggagaaagacttcttaatacatttgaacagtctgctccaggggattatgacatgattttaatggatgtgcagatgcctgtcatgaacggctatgaggcaacgaaagcaatccgcagaagtacacataaactggcaaagacgattccaatcgttgccatgaccgccaatgcattctcagaggatatacaacattctttagctgccggtatgaatgcacatatttcaaaaccagtggagatgaaggttttaaaaaagacaataagaaacataaaatttggtgaaggggggtatcgaaacgcaggtcactgaatagtaataaataggtttgatgcgacagatgctgttgaacggatgaatgaagtggatgctgacaggtatgatctgattttcatggatattcagatgcctaaaatggatggttatatgacaaccagagaaattcgtactctaaagaacaacaagaaggccaatattccaatcgttgccatgactgcaaatgtgttgaggaattaaataatttgcataaagaagaacattttctctttttatctataagaaataatgttataatgtgcttggaaaacaaaaagataaaatggaaagaggcaaattatgaacattgaagaaaagttagagattcatgactgtccattatgtgacggtggtgcgttattagaagaagaaggcggctgtggttattatgtaatgtgtttagaatgtggatgccagtccgtaacgattgacttccattctgaagaagaacgtctcgaagcagcgaaaaagactgtagatttatggaatgccggtaaggtaatttcatgtaatccgggagaatgatataaagtacaatatcataagaacgtaaaaggcataagccgtaccgaaaaaatcttgatagtctggatacaggctatcaagatttttttattttaattttattcccagagggaaagttgtatctttacctatggtaatttcaattcttatctataccaaaattgaagtatctcatatttccatcgatttggtgctaacacaggatattttccaaaataaattttaacagtctgagatttacctggtttgatatttactttgacgtttttcttctttactggtttcatatcgtcccatgcatcatcaaaaaacagcgttgttttaagctgtacttttgtaatagtgcgttggcttttgtttgtaaattttatttttacatagcatttaccgctgtagctgtcataaattaacccggcttttttagattttagctggtcataggtaggggctgggctttttacagttattcggatgctttgttttttgccgttgataacagcacttatagttgcttttcctggcttttttggaattaatttctgaccagatacttttatgatttttttattgctggacttaatttttttaatacttggttcttttccatgaacggttacaaaatctctcatgaagtagtgataacccatgagcattgtccccttctttttctttataaaagcagttgatttttttacagtaatatcaagttttttgacaatagttttatactggatggttagtgttgcctttcctgctttcatcgcctctatttcaataccgatatccatatttggatgatagttggcaaaatcaatattatatttgtcaataacttttagtacggaaggattagaagaagtggcagatacttttgatgcagggatttttgaaaggtcaggatcgctaattgtagcgacaataatgtttgtgtgtcctggataaacattttttaaatcagcaaggcttttcgtatttaaccacatatttaaaaagtaagaatcatctgtctgagcatgaacctgtgttggaataacgaaactcaggcacagaagtaaaagtgggataagtagaaagattcgccggatccgaaaggcaaagtataattggttctttaatttctgttctctttttttgtttaacattttcatttcctccttttatgaaatatttagatgagagtaaaaacttcattgttgtggtcttatagcaaagaaagatggattatataagtgttataactgcccatactcttatcagagcaaacagaatagccagtacgccaattccaaaaaacaacaaactaagaaaatggcttcctccacctgttatctctttcaaggtttctgtcacatctgctggattttttggattataatatccaggacattcttttccaataggatattgatctgtagaacttcccaggcgggtatgatattcatattgctgcccatttaccgtatattcgtagaccggagtataagaggtaacagaaatcctgctttctggaccttgttcgttggaattggtttcttcccattcatttttttcgactttgattacacgcaaagtagtacgtccggtgtaacgttgctgatattcctcattttttttcgttgcattgtcccataattttttcccaaaccaaataaatagcaatcccaaaagcagtgggattactgctaatgtaaaagaataaatataaaaatgttccataattttcctccgttttgcatcatgtactctggaaatcagtaaaaatagttgccgtatgtaaatagagcgcttttagaatacaccctcgtttagataatgcagatcgtaagaagatgtatagttataaatcatttcatagtaatttgataaaatagttcttacacttttattatataaaaattcacatagaaagatagtgccttacagtcaccattttgatttagagtgtatttaaatcccccacaaattataatgcacatcttacagaaagcattttttaaacacgatctggtgttctctgtaaataaatctataagttaacttataaattaaatttatgatttgtgccataaatgaagaaaatagtgactgtcggatactggaagagataagtgcttttgtgataaactatatttattcaggactgtacgatttttattcatcgcatgagtttgtgtttggatataataagagaaatagaaaagaatagatacagaaaataatgaaaataaattgaaaatagatatagaaaaggaataggtcatggataggaaaagcgtattggaagtaggaaaagtgctgtatcactcgggtcttccctttcgagtgagattatttaatatactggcttcacttggattcatcatcagtctgtgtaatggagttctttcttattggaataatggagataggaaactactgttaataaatacagggattgccttgctatctttgtcgctccttttttacgcataccacagtaaaaaatatcaaagatgctactttataacaatcgttgtgatttttatgtttttatttccaattatgttttttaagagtggcgggtataaaggtggaatgccgtctttttatatttttggaattttatttactatttttatgctggaaggctggttaatgtttttttgtgtatggctggaactgataatctatatattcacgattgggattgcctattattatccagatacggtaatctggtttcaatcggaaaaagagattgttgtggatgtgctgacgggagttgttgtatcgagtgcttctcttggcgttgcgatgtatctacattttcgaatatataaaaagcagcaggtttttcttatgcaggcaagggaagaagcgatggaagcaaatcgcgccaagagtacatttcttgcaaatatgagtcatgagattcgaacgccgattaatgtgatgcttggaatgaatgagatgattttacgggagtctgagtcaagggaagtcgttcagtatgcaaagagtgtggaaaaggcggggaattatctgttatctcttattaataatatattggacattacgcgaattgaatcaaaaaagttagatataattgaggaaaagttttcattaagacaacttgtacaggaagtctgcctgattggagcaaagcaggcagaagcaaaaaatctggagtttgtagtagatgtagaggaaactcttccgaaatatctggaaggtgatgcattgcatatcaaacaagttatcctcaatttaattaataatgcggtaaaatatacaaaaaaagggaaggtttttcttaaagtttgtcaggaggaaaagcagatttctttttctgtgaaggatacaggaatcgggattaaaaaagaagatatggaagcgctttttgatatgtttatgagggcagatatcaaacgccacagaaatattgagggaagtggactgggtcttacaatagcaaaagaactttgtgaacagatgggagggcatattcaggcagaaagtatctatggaaaaggaagtaactttacagtatattttccattaaaagatgcaggaacagagaaaattggacagtggaaagttgtggaaggggaacctgtgcaagaaaaaaggaaggagttttttgcatcagaagcacagattttactggtagatgacagtgaacaaaatattcaggtgattacatcacttttgcgaagaacaggggtacagttagatacggcggccagtggttttgaatgtatcgaaaaagttagaaataaaaaataccatttgatttttcttgattatatgatgccggaaatggatggaattgagacatttcacagattgaaaaaagaggtaaatgggcagagtgttccggtgattgcacttacagcggatgtgtccacgggaattcaccagcattttctttcagaaggattttctgattatttgtcaaaaccggtgatgtgggagaagttggaagaattgctgttacaatggcttccagctgctctggtctcaatgaagaacggtgcgggagaagactggaacataacggaaaaacaacttttagatttgaagcaaaaattaaaaaaatgggatattgaactttccgaagggcttcatttattaggtggaagtattgtgcaatacagaaaactttccgagctctttgtagaatattatgagccaaatagaaaaaaattagaggaaagttttgagacaacgagaaaaacacagcaggaaataaaaatattgacaggacagattcatacattaaaaagtaatgcccgcgcgattggagcaatgtcactttatgaattagccgcttcacttgaaataagagggaaaatgcaggatgaaagctatatagaaaaggcgattcctcttttgttttttgagtgggaaagagcgttagatgggatgttttttttcttagaaaatacaaaaaaatttgttctggaatcagaaaagaaagaaaaagagaatgggaaacagaaggtatacggtgagctgacagaagaagtaaatcaggagaagttatatgaggaaacatatgacgggattttggaggcaataggaaaatatcaagggaaatatgcagaagaacagctggaaaaattgttgtctttagaaaagaatccaaagaaaaagaagattttgggacaggtacaaaaatcggtgcagaatttggagttcgaacaggcagaatcacttatgaaaggtacttactggacgaataaagttacgacagaatgggaggacagaaatgggcaaaaatagcatattaattgtagacgatgatttaatcttattaaaaacagcagaagaaatattgtcgagtatttatacggtcagcgtagcgaaaagcggaaaacaggcaattacattactaaaaaagggtgttgtgccagatttgatattgttagatatcgctatgccggaaatggatgggtatacgactctggaaaaaatgaaatctattccgaattgtcaggatattcctgtaatatttctcactggatttgcggagtcagattatgaagtaaaagggttaaaggcaggagcagtagactatattgtaaaaccttttgtaaaagaggtcctgcttgccagagtcgaaatgcatcttgaaagaagcgcaaaagaaacaggaaagtcttttgcagatgcagcaattgaaaaaaatcgtggagaaatacaaaagaagctgacaccaattgaatggaagattgcgctggcagttgcacagggaatggaaaaccgtgagattgcggaacagatgaattattcctatggatatgtgaaaaatgtgattgcccgtatcttttccaagttagaaattgaacggcgcagagagcttcgaaagctgcttatcggataatttgaccttgacagaaaaacataaagctgtagaatagtaggggtgtgttataaaaagaaaaattacagaatatagtggaggaatatatgaaaaaagattctgcaaaagatataaagattgctttttttgacgtagatggaacgttagttgatatggaaaaaaaggtaatcacccctgcgatgatcgagacattaaaacacctgaaagagaatggaattattttatgtatggcaacaggacgcggcccatatcttgttccatcttttccaggaattgattttgatgtctttttatcttataatgcgtcttattgttatacaaaggatgaggttattttttcaaatcctatcccaaaagaagatgtaaaggcaattgttgagaatgcatcggaaatccatcgcccggtgttccttgccggagtagaaggcggcggtgcaaacggttgtgataaagatttggcagattattttgccattgcaaagagtaaagtaaatatccttgataactttgattttgaaaaactcatggataaaaaagtttaccagatgatggtcggctgttataaagaagaatatgcagacattttaagagatgtcgacggtgcgagaattactgcatggtggacaagagcggcagatattacaccggcaaatggaaacaaaggtgtcggcgtaagaaaaattcttgactattatcatttagataaagagaatgcaatcgcctttggtgatggaacaaacgatattgaaatgttagaagctgtaggcactggtgttgcaatgggcaatgcaaccgatgatgtaaaagcagttgccgatgcaatctgcggacatgttgcagaagatggcatttatcattattgcaaagaacagggattgatttaggaaatagataaatttaattagggattacgttaaagattacgataaggagaacagatgaatataaaattagtagccgtagatatggatggaactttgcttaacagtaaaaaagaaatgccggaagaatttattccgtgggtaaaaagtcatccagagataaagacagtcattgccagcggaagacagtactatacattagaaagagactttcttccaatcagagataaccttgcatttattgcagaaaatggagggcttgttttcgaaaaaggcgagattatttttaaagatgagatagacaagcaggacgtgttaaaatgtcttgatatcatagataaagtaccttatgcaacacctgttatctgcggtgcgaagtctgcttacataacaaaaaaagatgtggatgaggaaatctactataatgtagaaatgtactacgagagaagacagattgtagaagatttaagaaaagtggcagacaatgatacaatcgtaaaggtcgctatctattttaagaaagaaaaagctgaagaatccatgaaatattttgaaaatatcggtgagaaacttacagccgtattatccggagcaagctggattgacattgccaacaaaacagaaagcaaggggaatgcaatcaaagctatatgtgaaaagtacggcattgcacatacagaagctatgggatttggtgactatttaaatgatatgtctctgttagaaagctgcggcgaaagttactgtatgaaaaacggacatcctaccttaaaagcattagcaaaatatgtaacagagaagaccaacgatgaaaatggtgtaatggaagtgttgaaaacactttaatttttctaaatagacagacgaacctgaaagaagctgcatatcgcagatgtatctctcaattttgtgagaaaagtatcttataaaagtttctccttgcaaatattgattttgactcagttgtaaaaaacacaaagtcacaaaatcaatatttgcaaggagaaacttttaacgatactatgttcgcgcagaattgagattacatctgcggtatgcagcttcttttgggttctgtttcttggcttttcaagaaaattaaagattttcagggagaactcgaatctcgactcaagtattgatttatcaaaaaacttattgacattttagtaagttacaactaacataaaatagaagaagaataaatatgttagtataaatgcataagaaataggaatacctaacgcgggctgtttggggctaacataaatttatttgaaatagaggaaagaaagttaagaggagagtttgagtttatgtttttggaaataaaacagattaaaaagtcttttggtatgggtgacagccggattgaggtgctaaaagggattgatttggagattgagaggggagagttttgtgttcttcttggaccttctggttctggaaagtctacgttgttaaatattattggtgggattgatggagcggattcaggcagtattacaattgatggagagcgtatcgaggatatgacagagaagaagctgtctttataccgaagaaagcatctcggatacatttttcagatgtataatctgattccgaatcttacagtgagggaaaatattgaggttggtgcatatttgagtgacaagccgcttgatgtggatgaactgttacatacacttggtatttatgagcatcagcgcaaattgccgaaccagctttctggtggacagcagcagagaacagcaatcggaagagcaattgtgaagaatccagacattttgctttgtgatgagccaacaggagcgttagattataatacatcaaaagatattttacgccttattgagacggtcaatcaaaagtatggcaatacaatcgttatggttactcataatgatgcgataaaagatatggcagacagagttgtcaagttaagagacggtatgattcgaaagaattatacgaatgaacagaaagttccggcgatggaactggagtggtaggaggagcgagatatgaaaaatcctttaagaaaaaggcttcttcgggaactacggcaggaaatgggaaagtatcttgttgtatttattctgatggtagcaacgattgggtttgtttccggctttttagtagcagatggaagtatgctgactgcctatgataacagttttgaaaaatataacatagaggatggaaactttgctacagaagaaaaagtttataaaaatcagcaggaaacaatagaaggctatggtgtaaaactttatgagaatttttatgtagagaaagctctttctaatggaagtactcttcgtatttttaaaaacagggaagaggtaaataaagtctgtctcatgaagggaaaaatgccgaaagaaatcggagaaatcgccattgacagaatgtatgcagataataataaactatctgttggagatacattaaaaagtggaaagaagacatggaaaattactggtcttgttgccttgtctgattacagtgccttgttccagaataataatgatacaatgtttgatgcgataaagttcggtgtgggcattgtcacaaaggaagaattttcttcttttaatgaaagccagcttacctatgattacgcatggaaatataataaaaagccaaagaacgaaaaggaggagaagaaaaggtcagaagatttcatggaagatatcggaaaagatatcacgttagagagttttattccacagtatgttaatcaggcgattcattttacaggagatgatatgggaagtgatgaagcaatgatcattgtacttctctatattgtcatggtgattatggcatttgtatttggaattacaacaagtaatacgattcgaaaggaagccggagtcatcggaacactccgtgcatctggttatacgaaaaatgaattgataaggcattatatgtccatgccagtttttgtaactcttatcggagcggttgtcggaaatattttaggttatacgatctttaaaaatgtttgtgcaggaatgtactatggaagttatagcctgccaacctatgtcacagtctggaatgcgaaagcctttttacttacaacggttgtcccagtactgattatgcttgttgtcaattacggcatactgcgcagcaagttaaagttgccgccgcttaaatttttacgaagagacttaagcaggaaaaagcaaaaaagagcattgcgcttaagctcgagaatcaatatcttttcaagattccgactgcgtgttattttccagaactttagtaattatattgtattgtttgtcggaattgtttttgcaaatttattattattttttggattacttttgccctctgtacttgaccactatcagacagacattcagaacaatatgttggccaaataccagtacatgctttctgttccgaccagtgcaatgagcggcaataaaatatccagtttattttctttgctggagtattcgcttggagcaaaaacagaaaatgaagatgcggaagaattttctgcgtactccttaaacacaacaccgaaaacctttaagagtgaagaagtcactttatatggtgtgaagtccgatagtaaatacgttaaaattaatttaaaagatgaaaaagcagatttacaggcagatagtaaggtcacagccgatgcgtatatttcttctgcctatgcagataaattttccttgcagccgggagatatgatcactttaaaagaaaaatacgaaaaagataagtataccttccgggtaaaaggtatttatgagtataatggaggcctttgtatttttatgaaccagaatcagttaaaccgtatatttgacctcggctctgactattacagcggctacttctctgataccaaaataaccgacatcagtagtaaatatatcggctccgtcatcgacttagatgccttaacaaaaatttcccgccaattagatgtatccatgggaaatatgatgggactgattaatggatttgccatcgccatatttttagtacttatttacctgctctcaaaaattatcatcgaaaaaaatgcccagtctatctctatggtaaaaatacttggttacagcaatggggaaatcagcagactttacatcctgtcaacatcactcgttgtcgtgctgtgcctgctcttaagctttccagttgaaaccatattgatgaaaggcatcttccgggagatgatgcttcagagcttatctggatggattgccctatacattgacccaaagatttatgtcaaaatgtttgtaatcggactggtaacttatgcggtagtcgcattgcttgagtatcggaagattcagaaagtaccgatggatgaggcattgaaaaatgtagaataaaaacttttgatttgtagagttggcaaagcagacgccgctacagaaaagtgatggtcggattgctagaagaattatgaagaacctctaaaagatttattgattttgttccgttgtgctaaatgctccattttgcccaataaagcagaaacttgctctcaaaacctccactggagcttttttcgacctgctaaggcagcacaaagtcacaaaattcaataaattttttaggggttctttttcatattttttgagcaatccgatagagtagtatctatagcggctgtctatcttgaattctacaaataagttaaaaaatttgagggagaggacaggaaagacagctatgtcagagaattaaatatcataggattgacaataatgcaaggtcagatatgttagaatcggaatataccgtagtttctaatatcaaccggcatggtattgctccagtagaggcagcggcatatattgttgatcttattgaacggatattgaaaacaggaaaaagtggagtggaactctgataacagacaaacagacgcaccccaagagaaaaactactcatgcaaaatcagaattccaactttcttttgtccccatcttcaaattttctcaactgatttgtgggattggaatacacagaaccctcatctcctgtaatatataaaaatgcgcctttgagcaagttcaagttgcggatgaacagcttggacgcagggaaacgaagcatttttatatattataggagatgagggttcgtctgttccacagcctcacaaatcaaaattttttgtggtattttgtttttacatcgtatttgttagtataggaagtatcaatttgatacctgcctatctttgcaatataaaaagaaaaacagcagtgaaattaaatccaccggaagacataaggtatacgctacaggtgtatttttcacaaaaggaaaatgcgttgttatttacaaatgaaaaagaagtttatctggtaaatcttgagaagtaaaggagtgaaaatgatgacagataaagagattatcgctttatattttaagcgttcggaaaatgctattgaacagactgatgaaaagtatgggagactgtgtcattcgatttccatcaatattttaaatgatacgagggacagtgaggaatgtgtgaatgacacctatcttacactctggaataagattcctccgaaagaaccgaacccatttaaggcgtacatatgtcgaattataaaaaatctttccctgaaaaaatacgaatttaatcatgccaaaaagcggaacagtgcgtatgaaacgtctctcgatgagctggcagaatgtgtgagtgatggaacggaagcatctgacagcgtagaatttgaggagttgcggacagcaattaatacattcctttccgaacttccggagaaaaaaagaattttatttttacgcaggtactggtttttacagccagtgaaagaaattgcaaaagactatggaatcacagaaaaaacagcatctatgcgtttagccagacttcgtgaaaagttgcagcaatatttgcaggaaaaggagttgatctgatggataaaaaagaactgtttcgtgcgattgatgcctgtgaggatcgctttattagggaagcggcagaagatattcaaaaaagaaaaccatcaatgattcgaagatttttctttgtaaattcttcagaaaacacagaagaaaactcggaaaaagatgtgagaaaattgtctgggttaagagttgctgccgcaattgtaatctgtgttgtagtgctaagtattggagtacagactgcagccagagtttctactgtttttcgtgattggattgagcagacatttcagataggaagttcttctggtgatcaacaaggaaaagagaatcagtatataaataataatggaagtggaaaaaacggaaataacaagaaaggttataataacaatacctcaaatatcgattcatacggtaagaatgataagaaaaattctgctgggaaagaagtaaaaaatggcagaagtaatgaggaagaaacaggaagagttcaccgaagaaataacaaagcagatgaagggcaagactccatttcacaaattgaaaaagtgccaatgaaagataatctgcagattgtgggaacgaatgaaagttttatttatgaaagtaaaacggatgcaaactccgatgaaatcgtagagaaagtctatagtattaaagatggtaaacttagcaaattgccaatacaatccttttcgggcagctacaaggcaagtacattctctttccaatattctatcattgggcaggagatttttagctataattatagcaaaaatctggtacaggtatttgaccagataaataagcagggagaaatttacctttccgcagaaaatgccaaagaaaatgaacaaattctttgcgtaaatttaaaaagtggagaatgtagacaggtcgtaaaacctggggacggaatgaatatgagcatgtctccagatggaaaatatatcttaatcaatcacagcaaatcatattggactgtttttgatacagaaaaagaaacagaaagaaaactagaaggactttctggatacgcactttccaatgaatatgatttcattaatgatgaccatattgccgctgttggagatgtatttaccaaaaacaataccgaattctatcgcctgaattatattgactttcaaacaggaaaagtaaaagtatatccggaatatggagatatcaaaggctgctggacgtatcggtgtgatacgaagaaaaaacagttggaaatagagaatcttatcacaaaacaaaagcagatgattcctttaaaacaagcagaagatgttcatataatgcaagtcaatggagagtatgttttattaggaacagagtctgacgatgtatattatctttataatttgcaggaggatatttatcgagaattagatatcccagaagaaatccggggaacactggagatgtatattgcgaaaaaggagaagaaattacttttcacaaatggaaaagaagcgtatttggtagatttaaaagaaagataagattatcttgttatactgttttctgaatggtatactaaaaacataaaaaagccgtgtgaattgaaaattcggtgttcacacggctttttaaaaaaatgatgattagatagaactaacatgtgcaaacacattattttatatataaatatggaggatgaagggatgctatattcagaagaagtaaaaatttttaaagaaacccatacctacattccgttgccgtagcccactacgccgcccttgttcaggcaaaatcttctacaaattgtaacgcacatcttgcagaaagtatttttcaaacacgctctaagacaaaatgtttcatttatgaacagcctatttgtctaatcttttattttttgaaatcaagaatgagtaagattgtaatgggtaaaataagaatagggaaagtaggagcaatttacttatactttgtttatacaatacaaagtataaacacataacctcaattagttttttctaataaatgtacaatacataaaacttgcaatagttttctgataaaaaatatctttttttgtaattgtgttagcaatatttccgtggtagaatagtataaaaagagaagggggattattcatgtattcattagtagatgcatctttaaacacactgcatactatcaagtggaatatctgcagtgacgagaagatgtcattattagaaaaactggggttagtacagggagcaaaggtaagtgtgattgcttcctattttggaaatgtaattgtatcggtcaatggaaaaagaatcgcaatagaaaaagataccgcagaaagggtgaaggtttaaattctgagttgccgcaggcaagggagacgccctctggctggagaggtgaaattacaaatttaatgctagagcgtgtttgcgttccccaatcttttaacggatttataggattggagtaaacagagccagcgaaccttgtaatatataaaaatgcgtcttagagcaagttcaaattgcggttgagcagtttgaacgcagtgatacgaagcatttttatatattacaaggttcgctggctcgtttgtactttagtattcatagtgtagaaaaaaatatgcattttctaacagaatatttttctgaaaataggtatcaaacacagagattgtgtattataatgggattcggtaaaagagaaaatacatttgattggaggatttatatgaagaaagtgccaataaaagaattgagagaagatttaaaagaagaactcaaagaggaactggtttcggattcagcgattcttgataaacagaggatgggagaggaaatgtatcataagttagagattcgcagagatgtgaaagattcgattgtggttatcattgcctcgattttgtatgcgataaacgttaatgttttcgttaatgcgggaaatctgcttccaggtggagcaactggaatttccctgctgttacagcatatttgcagaacatttttacatatcagtgtgccatattcattattcagtattcttcttaatgcggttccggcaacgatatgttaccgggtagttggtaaaaagtatacacttcgttcggttctttgcatttttgtaatgagtattgccgtcgatatgattccgtctcattttattacagatgatttattattaattgcgatttttggtggaattattaatggtgttttgattgcactgattttaaatagccatgcgacaagcggtggaacggattttatcagtatgattatttctaagaaaaagggaatcagtgtgtggaattacattttcatgggaaatgtagccgttcttttgattgcaggatgtatttatggtatgaatgtggcattatattctattattttccagtatgcatccacacagatgattaatatgatgtacaagcgatatgataaggataccttatttattatcacgaagaaaccagatgaggtttacaatattattctgaaaaagacaaaccatgatgccaccttatttaagggggtaggctgctataagaacgaggaaaaagcgatgctttatagtgtggtgaactcagatgcgacaagagtagttatcatggatattaaaaaggaagacccggatgcatttatcaattattttggttcgaaaggagttcgtggaaagttctattatcaggaagaggagtgacatcctcccccacctatagaggtgggggcttcccaacctcggcaagtttggttctcgttcgataacactactgtgctaagcataagcgagctatccccgtgtgtcccacggttgtgtttgttctaaagtcatgcatttaccagccgcattccctcatttctgatatttaccgccgcatttacatctctgtcatgatggttcccacactgtggacaatcccactctcttaacgcaagatctttcgtttttgcatttttgtaaccacaaacagaacaggtctggctgcttgcaaaaaatctatccaccttcacaagtttcttaccctgttcctccagtttgtatctcaaaaatgttgtgaacattccccagccgttatccgaaacagattttccaaaatttagcaaccgcgacatcgctttcatatccaaatcttctatacatacgcaatcataggcattggttatctgccttgactgcttatgcagaaagtcttttcgttgattggaaaccttttcgtgaagttttgccaccttaagtctctgcttattgcgattgtttgaacctttctgcattttggaaagcttgcgttgttctctcgctaattttttctccgcattcctgtaataccttggataggcaggctccttaccattgctgtcacgatataattcacgcatggaaaaatccagacctaaaaacttttgcatctccttttcctgtacttgatcttcatactcaaaaaggatacttgcatagtattttccgcttggtgtctgacttactgttacagatttgagtctgtattcctctggaataatcctgtgctgttttaaccgaacttgcccaatcttaggtaatttcaaatatccattagacagcgttatgttcccattgatgcagactgtggaatagctgtttttattccgcttttttgatttgaaccttgggaaacctgttttcggctgtttaaaaaagttctgaaatgccgtatcaagatgcctgagcgattgttgtaatgcgatactatctgcttcctttaaaaatctgtattcttccgttttcttcattgctgccatttcttttgcacaaatggtatatgttacgtttgtcttgttctcctcatactgccgaatctttctatcaagccaatgattgtataccattctcacacagccaaaagtcttagcaaacaaaatcttctgttcatcattgggatatattctgaatttatatgctctgtttgccaccatgccacttccttttccgcgaaaaaccgcctgcgatacttgaacataagcacaagatgatagtatagtaagaatactaaatgtgcgttactatctcaatttattgtatctcaattttttattatccgactaaagatactatactataattaggatactctatcaagtaggtagcagacgcaattgatcccccaccttagaggtcggagtcttcttgctgtaaaaggataaaaaaataaaaaatcatatatttcctattgacatagtaggatacttctggtatgataagcccatgaaacaaagaaacacaaaacaaagagaggtggcagacatgaatttagtaacttcaaagagaaaattcatacataaggacgatcgaatgtgtatgtgctgctgttgctgtaaagagaacatttaattagaaatttaaagattaaaatataaagagtacataatatatggaggataaaaaaatggcaaagaaaacatataaggatagagattttaaatttgaaacattacagttacacgttggacaggaaagtgcagatcctgtaacagatgcgagagcagtacctatttaccagacctcttctttcgtattccacaattcacagcatgcagcagaccgtttcggtttaaaagatgcaggtaatatttacggaagattaacaaatcctacagtagatattttcgagcagagagttgcagctcttgaaggtggcgttgcagcattagcaacagcttctggagcagcagcagtaacatacgcaatccagaacgtagctttagcaggtgaccacatcgtagcagctaagaacatttacggtggaacatataacttacttgctcatacattagtagattacggtgtagagacaacattcgttgaccctttaaaaccagaagaattcgaagcagcaattaaggaaaacacaaaggctttatacatcgaagcacttggtaatccaaactctgaagtaacagatatcgaagcagtagcagaaatcgctcacaaacataacattccattattaattgataatacattcggaacaccttaccttttaagaccattagagcatggtgcagatatcgttatccattctgcaactaagttcattggcggacatggaacaagtatcggtggtgttatcgtagacgatggtaagtttgactggaaagcatccggtaagttcccacagctcacagaaccaaacccaagctaccatggaatcagcttcgtagatgcagcaggacctgccgcatttgttacaagaattcgtgcgattcttttaagagataccggagcaacactttctccactccatgcattcattttcttacagggattagaaacactttccttacgtgtagagcgtcatgtagagaacgcactgaaagttgtagaatacttaaagaatcagccattggtggagaagattaatcatccttctgtatctgaagatcctgaacagcagagattatataagaaatacttccctaacggtgcaggttctatcttcacatttgaaatcaaaggtgatgcagagacagcaagaaagttcatcgacaatctggaattattctccttgcttgctaacgtagctgacgttaaatctcttgtaatccatccggcatctacaactcatgcagagcttaatgagcaggagcaggcagatcagggaattaaaccaaacacaatccgtttatctatcggaacagagcatatcgacgatatcattgaagacttagatgaagctttcaaagccgtagcagaataatagggggcgcttatcatggcaaaggtttataaaggaattcaggaattaattggaaatacacctttagttgaggcagtaaatttagagaaaaagttaggattaaaagcaacattattattaaagcttgaatattttaatccagcaggaagtgtaaaagaccgtatcgcaaacggaatgatcgaagacgcagaaaagaaaggtcttttaaaagaaggcgcaacgatcatcgagcctacttccggtaacacaggaattggtttagcagcaatcgcagccgcaaaaggttacaaagctatctttactatgccagagacaatgagtgtagaaagaagaaatattttaaaagcttatggagcggaaatcgttctgactccaggagaaaagggaatgtccggggctatcgcaaaggcagaggagcttgcaaaagaaatcccaggaagctttattccaggacagtttgtaaacccagcgaaccctgcaacacataaagcaacaaccggaccggaaatctggaacgacacagaaggtaaagtagacatcttcttagcaggtgttggtacaggtggaaccgttacaggtatcggagaatatttaaaagaacagaatccagatgtaaaagtcatcgcaatcgagccagcaacctctcctgtattatcacagggacatggcggtgcacataagattcagggaattggtgcaggatttgttccagatgtattaaatacaaagatttatgatgaagttttcccagtagagaatgaaaaagcattcgaatacggaaaagaacttgcaaaagcagagggaatcattacaggtatttcttcaggagcagcattatatgcagccgtagaagttgccaaacgtccggagaatgaaggaaagacgattgtagtgcttcttccagataatggagacagatattactccacagcgttatttcagtaaatcctgatttgcgcagcaaaggagacgctcccaaagagagacaataccctatatttgtgactttagtcgctgcaggttgaatattcgcttaaaacgctcacatccaacctttgctccgaggccacaaatatagggtattgtctctctttgggagctgtctttggcagttgtcgcaaattcagaatttatttttggagaatttgaggaaggctccagatggttatggcattccgaggagttaaagttctgaagacctgacgcttaaaccattcgtagaaagcatttttcaatagaatttactttcccggatattctatatctccattcttcttcctcaaatccttccaactgatttcccaagctgccaacgagcagaactcagggagataaataaagcatatttgtggcctcggagcaaggtttggatgtgagcgctgtaagcgaacattcaaaccgcagcgactaaagtcacaaatatgctttatctccctgagttcgtccgtctcggcaaatcagaaattgtatgttataatatttttgaagtagaaaaattagcaaagtaataggaggctactatggttattgagaataatcccaaagaacttgctgctatgaagaaatttcatgaaggaaacagagcagaaggattaaaactgcaggaggagtttgcttcagagtttcgtgaagaatataaagataaagatcattgtccctgtaagaaagcctgtcgttatcatggaaattgtaaggaatgcgtggcgattcacagggctcatcaggaacatgttccaaactgtatgcggccgatgttgaataggaagattaagatactttctgagttaacggaacatactcttgctaatgagatagaacctcctaaagaacatttgagaaaagagtttctctagaatgtgtttaaaaagtattgtttgccaatcgcttgataaaaaaactcaattagtgtattttaaaaggaaaagcagttgatgaaagagggggttaaacaatgaaagagaagaaatatgttgctgagaaaatagagaatttccaggcagagattcctgtagaagaatatatgaaagaatgcgtggatgttgcaacattccttgaattttgtaaagaatgctcgaactatgggaaactatggtgctgccctccgtatacatttgatgtggaaaaagattattggaacaaatatcgcaaaattcaaattatggggcgaaaattatatctgcctaaagaacttacaagccagtcctatattaaaaatgaacaatggaaagtaacagaagagtttcttctcccttataaagaagaattagaacaggaaatcttaaagttagaacaggagtatcctggaagtgtttctttaagtagcggagcctgtttacattgtaaaaatgcagagtgtacacgtttgtctggtaaaccttgccgttttcaggataaaatgcgttattcaatagaatcattgggaggcaatgttggcaaaacggtaacgaagtatcttaagcaggaattacagtgggtggaagaaggaaaactcccagaatattttatgctgatttatggactgctaattccgtaaattttggtttgccgtaggcaaggaagacgccactgagaagaaatctataaccggattgctagaaggatttgggaaagaggtgcaattatgggaatttatttaaatccggggacaatagaatttcaggaaagtataaattcagaaatatatgtagataagacaatgcttattgagagaacaaatgcagctcttagaacaaaacaaaaatatatgtgtatcagccgaccacgaagatttgggaaatcaatggcggcagacatgcttgcggcgtattacggaaaagataatgattcagcggcattatttgatggattagagattagtcactctgagacattttccacgcatttaaacaaatataatgtttttaagataaatatgcaggaatttttaagcatgacgcagaatgtagatgagatgcttaaagtgcttcagaaaaggctgcttaaagaattaaaatataaatatccagaatatgtagatagtgataatctggtatttgtcatgcaggatattttttcttatacggggcagtcctttattattttaattgacgagtgggattgtctatttcgtgaatataaagaggatgaagaggcacagagaaaatatctggattttttaagggtatggttaaaggataaagcatatattgctcttgcttatatgacaggaattcttccggttaaaaagtacggaacgcattctgcattaaatatgtttatagaatattcaatgacagaccccggaaatatggcagaatattttggatttgcagaaagagaagtagaaagtctttgcgtagaatatggaatgagtatagaggaaacaaaggcatggtataacggatacggtctttatagccataacaaacaggaagatattttatattctatttacaatccaaagtcagttgtagaagcaatgttacgtcacagatttggtaactactggaatcagacggaaacctatgaagcacttaagatatatattcagatgaatatggatggattaaaagatgcaatcattgaaatgcttgcaggtaatagtgtgagaattaatataggtacctttcataatgatatgacgacatttgcgacgagagatgatattttgacattgcttgtgcatttgggatatcttacttatgatgtagaaaaagaatccgttagaattccgaataaagaggtggctcaggaatatattaatgcaatcagtacaatggattggaaagaggcgatttctcagattaaggataaaaaatatgccttaaagtttcagggaaagttagaagaatagcctaaatatacaggacgaattcttgcggtagggataggttacgataaacagacaaaggaacatagttgtaaagtagaggtgctagaatgacaacaattttatgctatggagattcaaacacatacggttataatccggtaaatggtttgcgttatccaaaagatgtacgttggacaggtgtattacaaaagctgcttggtgaacaatatgcagtcatagaagaaggctgtaatggaagaacaacagtttttgaagatattgccgaaccatggaaagcaggacttggctatttaaagccttgcctaaatacgcataaaccaattgattttgtgatcatgatgcttggaagtaatgatttaaaaagaatgtttcacgcaacagcaaaagagattgcagatggagcggagcagttagtaagtattataaaagaatttacaaaagaaaaacaaggtttcatgccgaaggtaattctggtatccccgccagagattggggcagatattgcaacttcagaatttgcccggtcatttgatgaggatgcaattgaacgttcaaaggagcttccagttttctacgagaaaatcgctaaaaaatatgattgtattttctttaatgcggcaaaagtgatagaatcatcgaaggtggattcgctacatttgatgccagaggcacataaaaagttggcagaagaactctataaatgtattatggaaaatgaataaagaaaagagaaagataaacttactttcgaaattggcactcgtcccttgacatggctaataatatctgtataataaaattaggcagaataaagagcctcgaaagaagggataacatgtttttttggaaaatagatgatgagaccatacgatgccttattaataaggaggagatagggcagatgggctttgatttaaaggaacttggtgaagataatgagcagatggaagaatttttgaatgccgttattgcagattctaagaattatattgaatggaatacagagaatggggtgcagaattatattgccagagcactgccatccgaacagttcctgattacaattagctgtacttttcaggatgtggcgatagacagggatttagaccagattaagaagatgaccacagcattgagagaacggatttctgatgacagaatcgacagtatctattctatgacaggggaagagaaggagcgggagtttgaatctttagcaagagatcttcatgatgtgtgtatggggaatactagtgaaagtgaaaaggatacagaagaagcagcaaagaatgtgcaaaatacatcttcagaagtatcttaccagcaatcggcaccaactaagccatctggttccacaatgacagacaaagaaaaaaaacagcaggcagtaagaccacatattccggcacagaagcttatatttgataattttcataatctgatggatttctgttctcttttgaataaagattattttattccatcaagcctttataagaaagcggataagtatattttactggtagagtttccagtagagatggataattctcagattatcacgttcatgataacagcagaagaatatggggcagaatgttcaaatcagagattagaagggtattatttgtcagaacatgcgaagttaatcattaaagaaaaagcggtggagacactttttcgcatgaattaagtttacatataaccaaaatgaaagaagtatgatatactagcagggaactggttaaaaactggttccctgttttttataataggtaattattcagagaagagaatatttttgaaaatttattttaaaattcacatggcgaagtaagcatgtgtaaaaaatgttaaaaatatagtttggtaaacatgttctgaataattattataattttgcagaatgcttaaaaataaaagaagggatagaatatatatatggatttatcagatgtgagaaagaatattgaccgtgtagatgcagaaatccgcaagctttttgtggagcgtatgacattagcagatcaggttgcctgcattaaggcagagacagaagataaaatttacaaaccggatagagaagagattatcattaagaagcagaccgagggaatgaagccagaattagtaagagaatatactgctcttatcaagcgaattatggaagtaagccgtaagtatcaatatggcagaactttagaacttcgtcagtgctttccgtttgaatatagtaagatgccagcagtcattttaaaaccgacgatggtaaaagaggaattatacatctgtgaagatttttcaaaagataaggtaattacggtgtcttcttatgaagagattggaaattatatcaaagagggcaaggcagatgctggaattggcattattgaggaagtgggaatcggtgtatccgatgaacttcataatctgcttgcggagaaagatttatatattacacactgtaaagtacaggaagatggcggtgtgcgccgtaaagtagtaacatttacagacaagctggttgttctcccatcccataaccgagtaaaagtaatgtttgaatgtccaaatcatagcggcagtatcagtagtattttatcaatgatttctgattatggcgtgaaccttacagagattcattcacggccattctggaaagataatagttggaattataagttctttgtagaaatgaatgccaatattgatacgaaagagattcgtgcattaatctaccagctttctcaggagacagcatatttaaagattcttggaagctatgcctgtgagggagacttttagagatggaatttttagaagaaaaaatatttgaccgtgagcagtatgatacttatatccgccggattcattatgatgaccgggatgcagtgatgtatgagaaaatgcttcattttctatttccatatattgtagaagaacgtggaatagaagataaagaaggacttatggaagagtatatccattggaatggacaattaattgaaaaatgtctgtatcatctgcctcatgatatcccgtacataaatatctgccgggcatatcagtcggttgtatttcttttcgcaggaaatataaaagagggaatggagcagctaagaaggattggaacagagaattttcagtatgatggtaaggctccaaagtcaattatgacgcaggatggtaaagtatataagccagtttctaaactattccttctatataattatgcaaaggttcttaagcaaaaaggaatgcaaggagagctagaggcatttcaaaaggaatacccatatgcatttactatttatggtgatgaagaacatagggaacatgacttgttttacaaagaacagatgggacaatacaaggatgtaatattttatccggtatatcagagagtttataaaattgggcgaggcccgcaggacttttttgtttattatgacgcagcaaagtctgtgcctgtttcacaggtgcctgaataatcttaaattatcaattatggattgatatggggataattaaaggataataacttattcagagtttaatagggaagaatacttataatactgaatggttaaaataatatttatggaggaaaaacaaatgaaagagtattcattgggaacaaaatgtgtacagggaggttatacaccaggcaacggagaaccgagacagattccaattgtacagagtacaacatttaagtatgagacaagcgaggcaatgggtcgcttatttgacttagaggaagaaggatacttttattccagattacagaatccaacgaatgatacggtagcaagaaagatttgtgaattagaaggaggaagtgctgcaatgcttacttcttctggacaggcagcctctttttatgctgtattcaacattgcttcctgcggtgaccatattgtatcatcatcttctatttacggaggaacatataacctttttgcagtaacaatgaaacgaatgggaattgattttacctttgtttccccagagtgtacagaagaagagctaaatgcggcatttcagccaaatacgaaagctgtttttggtgagacaatcgccaatccggcacttactgtattagatattgaaaagtttgcaaaggcagcacatgcccatggcgttccattaattgtagataacacatttgcaacaccagtaaactgccgtccatttgagtggggagcggatatcatcacacattccactacaaaatatatggatggacatggtgcaggattgggcggctgtatcgtggacagtggaaactttgactggacaaaatatccagataaatatccaggactctgcacgccagatgacagctatcacggtgtcatttatacagaacgttttggtattggcggggcatatattacaaaagcgactgcacagcttatgagagattttggttccatgcagtctcctcagaatgcatttattttaaatcttggcttagaaagccttgaagtgcgtatgaaacgtcattgtgataatggattggcagtggcacagtttttacagcagcatgaaaaggtaacgtatgttaattactgtggtcttgagggagataaatatcacgcattagcagaaaaatacctgccaaatggttcctgtggtgttgtaagttttggagtaaaaggcggaagaaaagcggctgagaactttatgaaacatttaaagattgccgcaatcgagacacatgttgcagatgcaagaacctgctgtctccatccggcaagcgcaacacatcgccagatgaatgatgaagagttagaagcttgtggagtaaaaccagatttaatccgctactcctgtggcttagagaatgcagaagacttgattgcagatcttgcacaggctttagatcagatttaatgttgataacgctgttatagcgaataagatgaaataaaattcaagtaatccattcaaaatcagaaagcaaagagagaatagaacctatactgtggtctgggagtaaatgttggatgtgagtgtttaagcgaacattcagcatgccgcgacgaaagtcacagatataggttctattctctctttggtttcattggcttttttatagttgcatgatatgtgtggtattaattggaatcagaaaaaacaaagaagtctcattttgtacacattttcattgtataatacattttgtaacaagttgttaacaaataatatatatttgctcaacatttattacgagaggagtttacaattgaaacataaaaagacactacttacatttttgatgctgtgtgggctgtttattttaagtaaaccagtatctgcagcaaaagttccagtcattaaagctggaaagtctacgaacttaaaaggaaccattatcaatgtcaagtatagcggagcggctgtgacgatggcgaataagtccgcgacaccatctattaagattggttctgagatttatgtaccatgcaagacactttttgctgataatggaattcatgcttcttatacagcaaatggtaacactgttacagtaaagaatggaaagcgcaaagttattttttatgcaaataagaaatatgcaaaagtcaatggcaagaagatgaccttaaaagctgcaccgtattttgttacatataagaaaagtaatataagagatttacttgttcctgcaaagcaggcagcagcgttcttaggtttaaaatatacttacagcagccgtgctaagcttgtgactcttggggtacgtagtggaattgagacttctgcaacacaggtgagcaaagtagcaaagacaagatttatcaataagatggggccgcttgcaagagcaaactataaacgtacaggcatccttgcctctgtaacaatggcacaggcgattttggaaagtggctggggacaatcaacattagcagagaacggaaataatctttttggaatgaaaatcagtttgtctggtaataattggtctggctccgcctgggatggtgtaaactattatgcaaagcgcacttatgaatacggaagcagaggcagatattctatcacagcaaagttccgtaaatattcctgtgcagaagattctatcgaagatcattcagcatacctgttaggagcgaagaacggaagcaggaagagatatgcaggacttacaaagacaaaaagttataaaaagcagcttcagattattaaaaagggtggctatgcaacatctggttcttatgtgaatgacttgtgcagggtaatccgtacatataatcttacaaaatgggataaataaaacacagatgcaaatgagaatgtcatatattattttatgaatggatttttgttgttacgaaaatatctataaagacagtatttgaccctataggcaaagtgtattatagtaaaagcaggttttggcctgctttttgttttttgataaggaggaagacattatggaaagaatgttagaaggaatggttatttttgtagccaaaatacataattatattttgtcgctaaatgatgcttacgagaaaaactttacagacaagcagctccactttctcgtaataggaattttgggaatgcttattttgatggtgatttatccattgtttaagctgttgagtgagaatcatattctggtgattgcatttatctatgtatttacagtaatcgtagttattacttttgctattgaaatcggtcagaagatttccgatagcggaacgatggattttgcggatatcgtatttggaattgcaggatttttgctgatgtttgtgatttttgctgttataagacaaatttttctggcaattatcaatttgttccgaaaaataggaaaacattagagcgtgtttgaaaagtatttgtaaaaggtctttttaatatactctacaggaagggtatagagtgataataactagatataagaagtaaaaaagaaatctgtcacaggatatattatcgagtcgtggatagatttctttttttgattttgttttgaaaaaatgtttaaaaatgagaacaaaatagcttttatttttttgttgttcatactttttccgaaattttttcatagatttttcagaaaattagtgtatgatatagaagaaaaggaaaataagcaagaatgagggaggctttttcatggataaattaaaaatcatggtcgtagatgacgagagcagaatgagaaaactggtaaaagatttccttaagaaaaaggattttgaagtcatagaagccgcagatggcgaggaggctcttgatattttctttaaagataaaagtatcagtttaattatttgtgacgttatgatgccgaagattaatggatttgatgttgtaaaagagattcgtcagtactcacaggtgccgattattatgctgacggcaaaaggtgaggagagtgacgagttgaacggctttgatcttggagtagatgagtatatatcgaaaccatttagtccaaagattcttgtagccagagtagaggcaattttaagaaggagtaataatctttctaccggagaagttcttaaagccggtggtattgaacttgacatcgccgcgcatgaagtaaggattgacggaaaagagattacgttaagtttcaaggagtttgaacttctgaattattttgtagtaaaccaggggtagcactttcaagagaaaagattcttaataatgtatggaattatgattattttggagatgccagaacaattgatactcatgttaaaaagcttcgaagcaagttgggagaaaaaggcgagtacatcaagacaatctggggaatgggttataaattcgaagtagattgattaggagcatagcatgagaaattcaatacgatttaagatgacctctatcttaattttaattgtcggatgggtgattgtatttacatggttcctgaataatacattttctgagaaatattatgtgtcttctgaaaaggcatcgatagtaaagacatttgataaagttaagaatattttaaaaaatgaagaaaatcaggataccattgatgaggaaatggaacagatatccaataagacaaacatcaagatgatgattgcacagtcaagtaattattattacagccagaatgtaatatttagtaatctgatagacggaagtaagacctacgaagagattcttggttatttagatcagattcggagtcaggttatacttggtaatgataaaggaaactttaaaagtaattctggaagaagtattttcccgtgggaaaacagtgcagagaataatatgtccacattaataaataagggatattttgtcacacagttaaaagatcaggcaagtgggcagaacggtatttatctattcggatttacagataatgattatctgattgccatgagagtgtctattgagggaataaaggcaagcgccgacatcagcagtcggtttatggcatatattggaatgataggtatcatacttggaagtttagttatctttatcttttcatcaaattttacaaggccaattaaaaatatggcagcggtagcaaaccgcatggcgaatcttgattttgatgcaaaagttactgtcacacaggatgatgaacttggcgaacttgggtattcgatgaaccagttatcggaaaagctggaatcaacgatagctgatttaaaggcggcgaacctggagcttaagaaagatatcgagaagaaggaaaagattgacgatatgcgaaaagaatttctctcccatgttagtcatgaattaaaaactccaatcgccttgattcaaggctatgcagaaggccttaaggaaaatatcacagatgatgaagaaagtaaagacttttactgtgaagttatcgcagacgaagcgaagaaaatgaatgcaatggtaaaaaaacttctcacacttaaccagattgagtttggaaataatcagcttagtatgcagcgatttgatgtatgccagatgattcagaataaaatcaattcttcacagatactctttaaaaagaaaaacactacagttatatttgaagaagaagcaccggtttatgtatgggcagatgaactgatgatagaagaagtattcagtaattatttgtcgaatgctttaaatcatgtttatgaaaatggtacgattcgtatctggtttgaacgtatggacagcaaccttcgcattcatgtttataacgatggtaaatgtatcccggaagaagaacttaataaattatggattaagttttataaagtagataaggcacgaaccagagagtacggtggtaacggtatcggactttctattgtagcggcaacgatgaaagcacatggaaaggattttggtgtggcgaataaagagaatggagtagatttttactttgaccttgatgcaaagattaagtcttaaattctgagttgccgcaggcaaaatagacgctcacagtaaataaaagaacctatatttgtgactttagtcgctacggtttgaatactcgcttatacacgctcgtatccaaaccttgctccgaggccacaaatataggctcttttatttactgtgagctgtctttggctgctgaagtaaagtcagaatttattttggggagatttgagggggcatcaggacttcgtttgttccgtctggctcgccagctcggcaaatcaggatttttgttcatggaattttaaatgtaaaatgataaaaaaataacaaatttaacaagaggtaatctatcgtgggttataaaaatacaaaaaaagtacaatatctagtgcttgttgataaaataaaaaaatcttcaaaaaatgcttgacgcaactctgctgttatgataatataatatgcgttgcacatgagaaactcatttttaaaagaaaaatgacaagaatcttaaaagaaaatgaaaaaacttcttgacagattaaaaatcatgtgataatatataaaagttcgcatcgcaaaaagcaaaaatcttcgaaagaagatgaaaaaaagtttttttaaaaagttcttgacaagaataaagtgatgtgataaaatataaaagctttcgcaagagaaagctaaaaaccttgataactgaataacaaaacaaccttgaacgttaattcaaatttcattcgggttttcctgagagtgatgtctgcaggaaagtccatggaacagaacgaaagttcaaaacctaaataaacagtaatgacaggaaaagaaccagtggttctggaccttgatctgacatcttaaacattttatttgagagtttgatcctggctcaggatgaacgctggcggcgtgcctaacacatgcaagtcgaacgaagcaccttacggattcttcggatgaaagtttggtgactgagtggcggacgggtgagtaacgcgtgggtaacctgccctgtacaggggataacagctggaaacggctgctaataccgcataagcgcacgaggagacatctccttgtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggctccggtgccgccgctaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtcgtaacaaggtagccgtatcggaaggtgcggctggatcacctcctttctaaggaagacaagtagagagttgttttgttattcagttaccaagtgaaaacttgataacgcccttccgggtggcgatgcgctcaggggacacacccgttcccatcccgaacacgatggttaagacctgagcggccgatggtactatgctggagacggcatgggagagcaggtggctgcccggttccttaaaaaatcttttgattgattttgagggaaccaagcaggtgtggcaatacggaagtggaagatgtaccttgaaaactgcacacagatagtttttcttaaaagaaaagcgacatcagatttctatgataagaaagaattgagactaaatcaattctcccaatagcaagtcgaaagacgaaaacatgagttttaactcatacgccgaatgttctctacgctaggaggaacaggaggcagccatttcttaggaaatggacatacaaaggtcaagcgaagaagggcgcagggcggatgccttggcactgagagccgatgaaagacgtgataagctgcgataagcttcggggaggagcaaatatcctttgatccggagatctctgaatggggaaacccggctgtatggactacagtcatccataagtgaatccatagcttatggaagggaacccggggaactgaaacatctaagtacccggaggaagagaaagaaacatcgattccgtaagtagcggcgagcgaacgcggaagagcccaaaccgtgatgcgtgcatcgcggggttcggactgcataagggattcagtaacggcaggagaacggctttggaacagccggccagagagggtgagagccccgtatccgaagccagagctgacccggcaggatccagagtaccacgggacacgggaaaccctgtgggaacgagcggagaccactccgtaaggctaaatactactcagtgaccgatagcgtatagtactgtgaaggaaaggtgaaaagaaccccgggaggggagtgaaagagaacctgaaaccctgtgtctacaagctgtggaagtacttcttaggtacgaccgcgtactttttgtagaacggtccggcgagctgcgggtactggcaaggttaagcacttcaggtgcggagccgcagggaaaccaagtcttaagagggcgttttagtcagtacgtgcaggcccgaaaccgggtgacctatccatgtccaggttgaagccgccgtaaaaggcgatggaggaccgaacccacatccgttgaaaagggtggggatgaggtgtggatagcggagaaattccaatcgaacccggagatagctggttctcctcgaaatagctttagggctagcctcatacaagtctgccggaggtagagcactgaatttccgcgggggcgtcaaagcctaccaaagaatatcaaactccgaatgccggacagatggtgtatgggagtcagactgtacgagataagttggacagtcaaaagggaaagagcccagaccgccggctaaggtcccaaagtgggtgttaagtggaaaaggatgtgggatctctaagacaaccaggatgttggctcagaagcagccattcattaaaagagtgcgtaacagctcactggtcgagaggtcctgcgccgaaaatgtccggggctgaaacaccacaccgaagccgcggaacccgtaagggttggtagaggagcattcttaggggagcgaagcattaccggaaggggatgtggaccgctaagaagagagaatgccggaatgagtagcgagagcaaggtgggaatccttgcggccgaatatccaaggtttccagagtaaagctgatctgctctgggtaagtcggggcctaaggagaggcagagatgcgtatccgatggacagcaggtttaagattcctgcaccccttgttatcagaactgcggggacacgggaagggaagcagagccgggaatggaaagcccggtgcaagcgaaggagtcgcagggttggaaaatccgccctgcatgagacgaaggcgtgatgcggagcgaaatgaagtagtgaagctgcggccccttcctgtcgagaaaagccgctatcgtgtagcaagggcccgtaccgtaaaccgacacaggtggatgaggagaggatcctaaggccggcgggagaagtgttgttaaggaactcggcaaaatgactccgtaacttcgggagaaggagtgctgcgcaagcagccgcagagaaatggcccaagcaactgtttagcaaaaacacaggtctatgcgaaaccggaaggtgaggtatatgggctgacgcctgcccggtgctggaaggttaaggggagagcttagcgcgagcgaaggtttgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacccgcgccaggacggaaagaccccatggagctttactccagcctgatactgggattcggtattgcatgtacaggataggtgggaggctaagaactcatggcgccagccgtgagggagccgatgttgggataccacccctgcagtactgggtttctaacctgcgcccgtgacccgggcgggggacaatgtcaggcggggagtttgactggggcggtcgcctccgaaagggtatcggaggcgctcaaaggtctcctcaggatggttggaaaccatccagagagtgcaaaggcagaaggaggcttgactgcgacaccgacgggtggagcaggtacgaaagtaggacttagtgatccggtggcataaagtgggattgccatcgctcaacggataaaagctaccctggggataacaggcttatcactcccaagagttcacatcgacggagtggtttggcacctcgatgtcggctcatcgcatcctggagctggagcaggttccaagggttgggctgttcgcccattaaagcggtacgcgagctgggttcagaacgtcgtgagacagttcggtccctatccggcgcgggcgcaggatatctgagaggagctgtccttagtacgagaggaccgggatggaccgtccgctggtggaccggttgtcatgccaatggcacggccgggtagccaagacgggaagggataaacgctgaaggcatctaagcgtgaagcccccctcaagatgagatatccagactcgaaagagtgagagaccccttagagacgatgaggtagatagggcagggatggaagtgcagcgatgcatggagttgactgttactaatcggtcgaaagcttgaccttagagagttattggaatagaaaaagatagtttgtgtgtggttttgaaggtatatgatataaaaaaagagccaataaagtgctttgcactttattggctctttttatttgatttactaggcaaagctgacgaactcaaaaagatacatactccatatctgtgactttagtcgctgcaggttgaatgttcgcttccctgttcacatctaacctttgctccgagaccacaaatatggaatatgttctatttcagggaaatatccccattgattgttgagattctcacgttctggaatggtttttctcccaagattccagtaatgttttgtacatttcctggtttttctttgatagaaagaccctctatgtcagaaaagatttttcctcgtttactgatgccatcgattttcattccagtattttcaggaagaagaagctgaatatttccatttaatgtttcacattctacaatattatttaaagaagtaaatgttgcctgaatcggactggaggaagtggctaatttagcaccgccttcaatatcatcagcaataattgtaccggaaacagaatggatatctgtaaaaccctctgcttttgtgatatgaatcaggcttgtagaagaaacgagtcggattcgaggtgcagtaattgtattcagagagatagaaccttctgttgtttctgcggcaaatcgttctaccttccagtcggcatccgtcataatgttaccgtactgagaggagagaagcaactctccattataggaatctggaagaaaaatttctatacaggtggcgggatttacggcttctcttcgaccgtaacgtattgttgttttaaagcggtttgcagtcacttttgcataatactcgctgccggtaagtccattaatatattctttgattgtaagggtatcatctgttgccttgtgtaaaaaaagcgtttcagcctgataaccaatctgtaatgtttttacggaagaaacatctaaagagagaatattatccggctcgttagataaaatttctgtgaaattcaagttttttgctttattattttgcataatcccaatgcctcctgtgccatatgaataatctttttttattataaaatagaaaatataatatagcaatattgaatcaggggtattaaatagataggtagagggagatttttaaattgaaaagatttttggtaggtagataggtaatataaagtgatgcagacgcaaaaaaatacaggataaaagacattaaattgtcaaaataaacatcaaaaaaggtaaaattacactttgacataaaaaaagtgacatggtatcattactaagtattatttagtatgcgtagaaaattgcacagtccgtataagtttttgtgaataagtaaaatatttttttatctttggaattttatgcttctttctttggaaaattctagaactgtgctattgtcataatagtctgctgcctccatttgctatgcagcggggccttaagaattaattttctattttaaaatccatactttttaacatcaatttcatataaatgtacttttggagtctttcttgcacttgattttgtggctgattttccaccagttgcacccgaatttcatcaacgtacgcatcatgtatgcctcaaaaatttggacacaactgacaaaaaatcttctcacaaaatcaagcacaaaaagattccgagaatacatagaaaatcaaaggaggaaacagtttgagtgtaaagcaattgggcagaagactgctccagattgttattgtgctgatagggattagttttttcacatttattctcacgtatcttgcacctggtgatccggttcggacgagatatgcggcaagtggcatggttccaacggaaaaagaactgcaggaagaaagagaaagattaggattaaatgatccggttttagtacaatatgggcgatggcttggtaaagttcttcatggagattttggaacctcctattcaaatgggaagccggttgcagaacttttatccgtacgtctgctaccaacattaaagttagctttttcggcgttaatccttatgttgttagtagcggttccgcttggaatgttatcggcagtttataaaaatacatgggtggattatctggtaaggggagtgacattcttgggagtatccattccaaacttctgggtaggactcatacttctttatgttgttgcattgaagtttagcctgcttcctgttatttcaacaggagatggatttgagaaaatcattttacctgcgataacactggcatttgcaatggcaggtaaatataccagacaggtgagaaccgctgtgttagaagaattgaataaggattatgtgacaggtgcacgtgcaagaggaatgtccgaacaggaaattctctggaagcaggtatttccaaatgcactgctgccattaattacattacttggattatcacttggtaaccttttaggaggaacggcagttgtagaagtgatttttacatatccaggacttggaaatctggcagtacaggcaattacggcatatgattattccttaattcagggatatgtactttgggttgcgctgatttacatggtaatcaatttactggtagatatgtcttatacttttgtagacccaagaatacgaaggaatgagagagggtgagtgtgatgcagaaaatattaaatttcataaaaaagaataagcagttttcctttttctttttattagtgattctccttatttttgtcgcagtttttgcaccagtgatcgccccgcaggatccgtatgtatctgacctgaaaaatgcattacaggcaccgaatagtgagcattggtttggaacagataagttaggaagagatattttttccagagtaatctatgcatcaagaatctctcttccagctacactgacgttagttgcgattatttttgtggcaggaacaattttaggaacactggcgggatattttggaggatgggttgacgcagttatcatgagactttctgatatgatgatttcttttcccggtatggttcttgccattgctgttgcaggaattatgggagcgagtataaagaatgcagtcatagcgattgctatagtaagctggtcaaagtatgcccgtcttgcacgaagtcttgtcatgaaaatacgacatgaagattatgtatacgcagcaattgtaacaggctcaaagacaggatatattttaagaaaatatatgctgccaaatgtaattcctacgcttgtaattaccgcagctacagacatcggtggcatgatgttagagcttgccgggctgtcatttctaggatttggtgcaaaggcaccggcagcagaatgggggctaatgctgaatgagggaagaacatatatgcagaatgctccgtggatgatgatttatccgggactggctatttttattgtggtagtaatctttaacctgttaggtgacagcctgagagatgtccttgatgtgagagaggaataataaaaaataacaaaaatagtaagaaaagaattatgggttttaataaagtttgggatagtgataactgagtaaagttagattattttataaattccaaatgaaaaaccataaaataaaaataagattataaaagaagaaaggatatgttatgaaaaaaatgaaaaagtttttaggaatcatgcttgctatggtaatggcagttacgatgcttgcaggatgtggtggaagcagcaaggagagtagcagcagcgataatgggaaaacattaaaatttggatgtttttcttattccgaatctttagatcctgcaaacatgattaactctgcctggtgtagcagccgttatggtattggagaatgtctttttaaatataaagatgatttaagtgtagaaaatacaatctgtgatgaatattccacagaagataacaaaacatgggtattccatatccgtgatggtgtgaagttctctaacggaaatgatgtaacgccttctgcaatcaaagcatgctgggatgttctttatgccaataaaacaggttcttctaacccatctaaatttatggattatgaatctatcacaccagatgatgatgcccgtactctgacaatagtattaaaacaggcaaaagcagaccttagaaaagatcttgcatatcctgtatttgtaattcttgatgtgagcggagattatgacttggcagagaacccaatcggtacaggtccttatgctttaacaagttttgattctaagacaaaagcgactcttgtaaagaataaatattactggaacggggaagttccttatgataatgtagagattgacttcttaagtgaagataataaagcattagcattacaaaacggagacattaaccttgtagagaatgtaacttctacttctgaccttgatacattaaagaaagatgataactttaatgtttctatcggacagggtgtacgtactggatttgcttatattaatgaaaaaggtattttaggagatgacacattaagacaggcagtacagatggcattagatcataagacaatgtgtgaagttactgtaggtggtttatatacagaaggtatctctgtacttccatccagtcttgcatatggctatgacaatttaaaaaatccatatacatataatgtagataatgcaaaaaaacttttagatgatgcaggatataaagatacagatggagacggaatccgtgagatgaacggaaagaagatttctattaattatatcacttatgagaacagaagactttctgactttgcacaggcgattcagacacagcttgcggacattggaattgaagcaaagattaattctatggatgcagacagagaatggaataaaatggtagccggagaatacgatttatgcgactctaactggattacagtaggtaatggtgatcctacagagtatatggcaaactggtacggtaagtctgatgcgaacttctgtaactataagaatgctgagtatgataaattatacgaacagttagacacagaatttgacgaagccaaacgtgctaaaatcattgaacagttacagcagattttaattaatgatgcagcagttatcgttcacggatattataacagttctatgatcagtgataagacagtgagcggagcaaacatccacacagcagattactactggcttacaacagagattgctccagcaaaataggaggtttttatgctcgatgttcaggatataaccgtcgcatatagcagtaatgcagaaccaaccattgaagggtttcatcttgagatgaaacccggagaaatctgtagtattgtcggagaaagcggaagcgggaagactacagtaatccgttctatattaggccttttacccagtgggggaaaagtgacaaaaggagatattctttttgagggagaatcgttacttcaatattcaaaaaagcagtggagagaacttagaggaacacagatttccatgatttttcaggattccggagcgatgatcaaccctatccgtaaaataggaagccaatatgtggaatatattcgtgcccataaaaatatctcaaaaaaagatgcatttgatatggcagtagaaatgttagaaaaaatgcgtctgccagatggaaagcgtattatggaaagttatccatttgaactttctggtggtatgtgccagagagttgggattgcaatggcgatgacatttcagccgaaacttcttctggcagatgaaccaacgagcgcacttgatgtaacgacacaggcacagattgtccgccagatgatggaacttagagatgactttggaacaggaatcattgttgtaacccataatatcggtgttgctgcttatatggcagataaactgcttgtgatgaggcaggggaaagtggttgattccggccagagggaagatattttacataacccacagtcagaatatactaagaacttacttgcatctgtaccggctttaaagggagagagatatgtctaaagaaaaagagcttattttagaagcaaaacatgtgacaaagaagttccctcttaccaaaggaaaagaacttattgcaaatgatgatgtcagtttaaagttttataaaggacagacactcggaatcgtaggagagagtggctgtggaaagtctacatttatgcgtatgatggtacagcttgaacagccaacttccggagaaatccttttcaagggaaaagatattacaaagatgaaaggggaagaacttcggaaaaacagaagaaatgtacagatggtcttccagaatccgtctacttcctttaacccaaagatgaaagtgggcgatattatctgtgaacccctcatgaatttcgggctaattaaaaagaaagaaaaagatgccgttgcaagaaaatatcttgaaatggtagaattgccaggagactttgctgaccgttatcctcataacatgagtggaggccagaggcagagagtaggaatcgccagagcaattgccttagaaccggaaatcattttctgtgatgaatccacatctgcactggatgtttctatccaaaaagctattctggagcttctcgtaaagctgcaaaaagaaaaaaatatagcaattggatttatctgtcatgatcttgccatgatatcaagtatagcacatcagatagcagtcatgtacatgggaaatatcgtagaaatccttccgggagaagaagttgccagaggagccttgcatccatacacaaaagccttactacagtccgtttttgatcttcatatggactttaacaagctgattactccgttagagggagaagcttctatgccaacaggagaattacaaggctgtccatttcagaaccgttgtgcgttctgcatggaaaaatgtcaaaaagaaaaaccagaattaaaaacattagatgaaaatcatcaaatcgcttgttggagaatttgaggattatccacatcatcaaatctcctccattattgaattgataaaaatcgagaaaagcgaaaaacagtaacagcaattctaaaattaccaacaaccagaaaatcgaagcccgataggattacaaatgtgacctcggagcaaggtttgaatgcgagcgcataagcgagcattcaaaccgccgcgactaaagtcacatttgtaatcctatcgggcttcggttttcgtctgtctatcaattaaaaagctgttactaactttccttcatcaattcaataatcctctccgttgcatgtccatcgcagcttcccatgaatttttctttgaagtcaataactctctgtttatcaaattgagtatcaatatttttaatactgtctaaaagttcatcttctgtctgaacaaccggaccaggagtaaattcagagtaatcatagtagaaacctctccagtcacagtaattatcgtaatcataagcgtagaagatcattggtttttcgaacagggagtattcaaataccagtgaagagtaatcggagatacagatatctgcgctacaaagtaaatcttcgatagaaaggtctttcgttaaatctcttgcaaaatgctgtaattcttctggaattaccggtggtttcttaacaaatgggtggtgcttgcagacaatgacatattcatcgccaagttcctgataaaaacgttcaaaatcaattttatctggagatttggcagtagcaacatgaccacggaaagtaggagcatagagaataacttttttgtcttttgcttctggcataatttcatataatttctgtctgcggctttctacaaattcactgtcataaaagaggtctgtacggctaacaccagttgctttaacaataccttttggaagatgcattgcttcttcatatgcccagatgacttctggactgctgacagttacatgcgtaagattttcgtagtttggatatttgtctaaagttgcggcagaagaaccgaactttaattcagcagtactgcgcccaaattttttaaaggctccacatgcatgccataaattgatggcgattgtttcttttcttaatggaatagaagaaagaatgagagaagcatcatcaataaatacatactttgctgtcgcaagttcttgtaacatatcatcaacacgttttgtaaattcacggccacgaataaagttaaactgtacgtaagaacattttaaatcatattcaccagattcttctaactttttgtataaatattgaaaagaattagaaagagtggtaaaacgcatttctaagaaaaggactttgttctcctgtactggctggttacagtaagattcatatttttttggaaaatatactttgtaacgataatatttacgcagctgtcttaactttgcaacaaatttctttttgtactttttaaaaaatgacataatagacatactcctttgcattaaatgaaataaaatatttgtattttgtgctttatattaaagaaatcagattagcaatcagggcagaaataatccctatggaggaaatcaaaaggttccatcgaaaaagaatatcaatcccatattgcagattccagtgaaataaaacagaaagacctgataaaataagaaaaaatacttcaagaaaaagcaggcccttgcaggcaagatgcaaatcttgtctgcttaactccatatttagagaaattcccataattatataaaggaatataaacagaaagattatatcagaagcttgtaattgttgcaaggctttaaagaaaattgtccaattctgttgaaaagaaagaggaagtgtacgaacattttctggaagaaacaggctgattatataaatgagacatgggccaaataataaggggccgatactgataaaaaactgcccgaaatcgccctgaagcttctgtaaaaaagaacggttttcatgatgcattttcacaaaaccaagagtgcctccggaatacagtgcctttttggtagtgcgataaaggcagatttgatcaatcttatatccaaatataagtccaaagagcaaatgccctatttcatggacaggtgtgccaacaagattgaaaaaatccagaataagatagctgcggtttttgttcgaaaaattctgtatagcagcatgccgggtctgccccataataaatccaaacagaattaaaacgaaaagcagctttacattaagttgcataaaataagtaatcatatagaatctccataaaattaatttggtttatataagcagtagcttgtgagagaaagccttttaacagtctatgaatttaatataacatttaatattgaattttttgtgaaaagcgtataatatagatataatatggcttattctacgatttgccattagtacattaagaaaagagggaaagaagaaatgagtcttatgattggagctgtagtaatcgttatcatcgttgccggagctgctttttttatgtctggtaagtctggtgcaaagaatactgcacagagcgaaacacaagagaaaaagggaagcgaaggaaaagaaactgctgtagtacaggaaaaagcagaatctgctgataagtcacagtctgcagaagccagagaacagaaagcgaaaacagaaagtgttttagaaaatgataaggaaaagggaacaggagaaaacacagaaaaaataatatctgaaaatcagaaagtaaaaaatgaagaaaaagtagatttcaaagaaaaaaacagacaaaaagaacagttatattattatattaatcatgaattacagactctttttgctacttataataaaggagaatggaatcggcttgaaaaactgggagatatgtcttccgctttatataaggaaaaagaaagtattatcgagggactgccatcttttacaggaacaatggtgaaagaatatttttcctgtattgactttaaggaggaagaagaaaaagctgtttgttatgtaaaagataaagaacagttaaagaaagcattcttacagtttatgatgccgttttatccatattattataaacagttaagtgagggcggacttcgtcacacagcattgcttcagccaaatacactccgcctgttccagcagcttactggtaaaaagttccgtccgggataccgaaaccgctatacaacaggagttcgggcttttgagtgggacaagaaccgctacaaagtgtatggaaaagatggaaagcttttgtgcgatgccatttttggtacggatggaattatagaaggttacggtcaaaagaaatatacagatgaaacacatcctgactggaatattgtggaagaaggaaattgggaaaatggcacatttgaaggtggaattttacgctatgaatacaaaaggcctgtagaataattgaaattcacctgtctattcgattatgtatagagaaaaatgcacaaaattttgtattttctttcgaaataacttgaaaacctgaaacaaaaccgatacaataaaggctgtgtgctgaagttcgaaagaacagggaatatagcacatacgcagatctaatatgtaatttataattaagctaagaagagaagaatcagaaagatttaagaaagaaacaattttcttagttaaattattttaggttatttggatttaataaaatggatgaataacaggaggtaataaaagatgtttaaaaaattagcagaacagttaaaagcaaatgcacgtactatcgttttcacagagggaacagatgcccgtattcttgaagcagcagataaactgacaacagaaggcattcttggagttatccttcttggaaaggctgacgaagtaaagagtgcagcaaaagaagctggttttaatattgaaaaatgtcagatcatcgatccagagcagtatgcagaaatcgatgctatggttgatgagatggtaacattaagaaaaggcaagatgacaccagagcaggttcgtgaagccctttccaaatcaaactactttggaacaatgttagtaaagatgggcaaggcagattgtctgttaggtggagcaacatactctacagccgatactgtacgtcctgcattacagttaattaagacaaaaccaggcaacaagattgtaagctcctgcttcatcatggtaaaaggtgataaaaagttagcaatgggtgactgtgcgatcaacatcgctccaaatgaagacgagttagcagaaatcgctatcgagacagctaagacagcaaaaatctttggcattgatccaaaggtagcaatgttatcttactctacatatggttcaggaaaaggcgagatggttacattaatggccaacgctacaaagaaagtaaaagagatggctccagatttagatatcgatggagaacttcagtttgacgctgccgtagcaccagaagttgcaaaagtaaaatgtgcaggttctacagttgccggacaggctaatactttcatcttcccagaaatcagtgctggtaacatcggatacaagattgctgcacgtcttggtgaatacgaagcaatcggaccagttcttcagggacttaatgcaccgatcaacgatttaagccgtggatgtaacgctcaggaagtttacaaaatggctcttgtaactgcagcattaagctaattactatttaattcattagacaaactacaggcgaagccattgctcccaataaggcatatttgtgattttagtcgcggcgtgttgaatgttcgctttatgcgctcgcatccaacatttgctccgagaccacaaatatgccttattgggagcaatggcttctgtgctgtggctggagaaggtgaattaaatagtaaatctcttgcttttaggaacaaggtttgttataattgcaacaagaaaccagggttacagacggttttttgtagcaattttttctattagaagaaagagaggtatttttttatggcaaacattattatcagtccatcgaagtatgtgcagggaaaaggcgaacttgctaacatcgcacagtatgctaccaaacttggaaagaagccttttatcttaatcagtgaaggtggaaagaaacgtgttggtggaatcattgaagatagtttcaaagatacaggatgcgaacttgtttttgaagcattccatggagagtgttctaagaacgagattaaccgtttggtagctatcgtaaaagaaaaaggatgcgatctggtaatcggtgtcggtggcggaaagatttttgatacagccaaagctgttgcttactatgtagagagtccggttatcgtatgtcctactatcgcagcaacagatgctccttgttctgcacttactgtagtttatacagatgatggtgtatttgaagaatacttatggttacctgctaatccaaatcttgtattagtagatacagatattatcgcaaaagctcctgcaagacttttagtttccggtatgggcgatgcacttgctacatattttgaagcaaaagcctgtcaggcaagtaacgcaacaagctgtgcaggcggacatatcacaatcgcagcaattacattagcaaaagtttgttaccagacgttaattgaagaaggcgtaaaggcaaaacttgcagtagaagcaggcgtatgcacaacagcagtagaaaaagtaatcgaagccaatacattattatctggtatgggatttgagagcggcggattagctggtgcacatgccatccataacggacttacctgcattaaagactgtcatcatttatatcatggtgaaaaagttgcctttggtactttaacacagcttgttttagagaatgcagacgaagacttattagatgaggtaatcacattctgcatggacgtaggacttcctacaactttcgcagatttaggaatcgaacatccagataaagatgcccttatggaagcagcaaccttagcagcttccccagacgatactttaggaaatgaaccattagaagttacaccagataaagtatatgcggcaatggtcggagcagatgctttaggaagatattataagggattatagtaatttattgaatcttattttggcccagccctcctgtgttggagggctgggctttttaaatttctgctttaatcaggtactttgcttccagcggtcgtctgttttggtctatctttaagaatattccaaccgaatctggcttcctttctgtgacagatccgatggagtcaccagcagtttcagaggaactctcgcctgtatcgtctccacatggctgataataccgatacttctctttttggactgtagtcgttctaagctattcataacggtatctagcaagtcatcatcaaggctgccgaatccctcgtctaagaagaagaattcgagaggagcggcgccattaagctggatggaagaggagagcgccagtgccagggagagggaggtaataaataactctccgccggacaaggtatcggaagggcggatagctcctccatttttattatcccggatgataaattctgcggaatcattgatttcgagggcatagttgccgccagatatttttgataggatgacagaggcttctctggcgatataggacagttttgactgtgcaacatattcaataaatgcattgcctttgaaaagctgttctaattcttttatcatatcttttttgtgggattctgtttcccatttctgttctaattcctcttttttggcaaggtcttttgtcatggtttcaatttgatgtgttaagaggagaatagaggagtctaattcttttatctgctgttttatgtctgccagttcttctttttggcgaatccattcactttcttcgatttctttttttccgagtttctcctgaagatagcgtatgcgttcctcgttttgccgcacatcatcataataggaagtaatgtctttctctaattttgttaactctttttcttccatgtagtaaagctcgggctggtctgttttggaaaaaccaagttcttttttctgagtaagataaagttcctgtacctgttttaagtgtgtctcagaggaacggctggtactttgacaggaagtaagttccttgttctttttctgtagttcttttaagctttgctgatagtctttctcagtgtgttttaaggctgtgttaatttcctgttgacgttgttgattttttgtgatttctgaaacaaaatccatatttatagaaagtgtttttggaaacttttctgtttgttctgcgataactttttcacagttttcgatattggcggtgagggaggaactcttattttctaagcctgcaatttgcgctgaaagaacttttatatccgaacggagtttttctaaatgttgtctttgttctttgatcgttatttctttctgctggcgttcttgctctttctgacgaagagtttctaaagtgtttgaaaaattctcgatattattatcttttcggagagtgagaatctcttctgcataattttgcagggcagagtgctgttctttcaaagtagcggcttgtctctcgcattgttccttttgtcgccgcaagtctccctttgcctgtaagtaagtagaaatctgtttggaaatggaaaaataatcaattggtttttctactatgacaggggaagcctgggatatattttcatttatagtaaagtggcggtctgtctcattatcttctatagtatcttcatctgtaatctctaaagcatcttttaaattagaaatatgtgtgtctaaagagaaaagttcttgctcaagctgctgaataagattttgctgggtttgctgctgcttttctaatttttttagtcctttttcaagatttttaaaagaaatctcagaaagttcagcctcttttttttctatagtttcggaatcgttttttgaaaaagcttcagtatctcttttagtagtaacgtcagaaatagtttcagaagaagtttttacattctcggcaatatgagactgtgaaacgtgttctttgtaaggagttccacaaaccggacagagagctccttcttctaattcttctcgcaaaagctgtgccatatggttttgctgccaggatttttgcttctgtttggcctgttcttcttttccctttataatgcctaactctttttttgcggcagaatgttgctcatttaaagcagaacgccgatggcagagctgtgtataaatatttttcagagacttttgctgaatggaaaaggcatcatgttcttctttaatttcagtgtttaaggtggaaagagcgttcgcattggtgttgtaattctctcgtttttcccggtaggtttcttccataacattccctttttcaaggagctgttttctttctgggctgattctgtcagcctcgattgatttttcggattcgacaatttccgaatgaatctgtcgctcttttttaaagtgttgttcctgcgtttcctttaggggagccagagaggctaaaatttcttgcagttccttttgggcgtttccttttgtctgttcccaggtatggatggtatcagcagcagactgtgcggtatgaagtacctgttctcttgcctgaagtaagggaagttcctctttttgagcagaagcagcggcatgatattctttttctgttttttcgaagtgagactgtaaacaagcagtctctttctggacggtttctaatttttcgcaagcctggtcataagcagactgtgcatttgaaacctgaatagaaaaagggcgcagctggtttgctttttttgtgatattcagattattttctttttcttttatggatgggagcagaagttctttttccttttgtgctttttttaaagggagaagttcctgttgtgtattgtacagttcctctgttttctgaaagcttttttctaattttgcaagctttttagaaaggcgggaatgttgtttggtatcacttttttcctgcttttgcagtttagaaagctgcacagaagaaatctcctcaaagttctttttttctccatcaagcttacttaaaagaagttcttgtttttgttttgctctgccaattttactggtgagttcgattccgtatttttcaagatggaaaatacgctgaagcataatgcggcgttctttattcttaagatgtaaaaattcgctgaactgtccctgaggaagaacaacggtgcgcataaaatcttcactggtgagaccgagtaaacggatacattctgcggttacctcggtaggcttatcagccaggacagtttcattttcgccatcgcagacgatcaggcggccggtcgtattgcggacagtcgaagtgtatgtgttattatggtagcggaaagaacgctctgcaagatactttcttgttcggtctgtcgtgatggaaaaaagaaaggagacagaggcagttgtttcgttcgtattaataaagtttttcgtatcacggggcagcttggcatataaggcgagggtcatggcatctaaaatagtagactttccgcttccggtagggccaaagatgccgaaaagtccctgggaagttaatgtttcaaaatcaatgacctgttcttcgcggtaactgttgatgccttttaattttagttgaagtggtctcatattaattctcctctataatgctcattaaaagagagaaagtttcctctccgatgtcaacgtgaaattttttgcggtaaaaattctttacaagctcgtcaaagggctgttcttttaggtcagaggcggaaaagtcttcgctttcatcttctggaagaacaggggtgatggagaggatatctgcctttattgctttcatttttttaatatcttcttcatgaatgtagtgatctgtcttaacttctaaatagacccagcattctctgtcggcatttgcctcgcattgttcgacagcatcatcgatattctcacaatgccacacttcgattggtttatatacaggcaatggcagttcccggattgtacaaggggagcctgcggtaagtgtaacggcaatcacctgcttgtcaaaagaagtctccctgacgttaaatggcagaggggaaccgctgtatcttgccttcgggcagccggggactttctgtggcttatgaacgtgtccaagagcaatataatccgcattttccgggaaaatctcaccgccgaccatgtagcttccgccaagctggatacttcgctcggaaccgtcctccacgctgttcatgacaaaaagatggcttgcgataaggtggatggaatcttcatgaaaatgcgttgctaatgagccgaaaagagaagacattttctcactgtaggaagccgctttttttgtttcttcttctgtctcgtcaagatagacttcgttcagccgtttttcacttggaaaaggaacgagaaggatatccgcttcttccccatgtataatcgcatggatatagccggcatcgctttctgtaatctcattcttgccatacataccgggtgtgattacggaatttggtgtgcctgccatgacgatgccgtggtctctggcaagaggtccggaggcaaccagccgttctggattatcatggttaccggcaatgacaacggtcatacaatcgccatttcttgataattgttttaaagtatcgtaaaaaagctgttctgccatggcggaaggattataattatcataaatatccccggcaatgatgattatgtcagcctgttcttcttcgcatatatttataaaatcttttaaaaacagccgttgttcctctaaacggctgtgtccttcaatattttttccaagatgccagtcggcggtatggattaacttcatcctgaccctccttttgattgtaatgtattctgataatgttgttagcaaacctatagcagagtgtatagagaaaaacttgtaaactcactatatgatttataatagaatataataaatttcggatatttctattgtatagtatttgttttccaaatgcaaggatatagaacaaaaattcgaacaagtattctgcgatgtcataaaaataaattttccaaaaacaagaaagaaaacttatttgacagatgagacaggactagtatagaatagaacggcaaagtaactacataaataaagaacaggtattgtagaaaataaattgcaagaaaggttctgagagtacatatataataaaaggaggaaatgttttgaaagaacaatggatgcaaaagacagttgttgtctggtttttagccatgatatgctgtctgctttggggaagtgcatttccctgtataaaaataggatataagatgtttcatatcgcatcagcggatgcctcatcacagttgttatttgcgggctgccgcttttttcttgccggtgttttagtgcttttacttggaacttccggtaattttaagttaaaaaagacagagattccgatggcaatgactttagctgtttttcagacgatattacagtatgtatttttttatatgggacttgcccatacaacaggagtaaagtcttcgattattaatggagcaaactcttttcttgtcattatcattgcaagtctcatttttcatcaggaaaagctgacggggccgaagattcttggctgcattatcggctttgcgggcgttgtacttgttaatcttggcggagcggggctggatatgagtttccactggaatggagaatttttcatattaatttctacagtatctgcagcgtgttcatcggcatttattaagaagttttccacgaaggcaaatccggtattgcttagtggatggcagtttatgatgggaggaacggttcttatcattataggaaaattaatgggtggtaagcttcaatttgagggaatcgcgccgatgtttcttttattatatatggcctgtatttccgcggtggcatatacactctggtctttacttttaaaatacaatccgccgtcaagaatcgctgtctttggttttatgaatccggtgtttggcgtcatgctgtctgctcttttattaaaagaaaaaggccaggcgttctccttaaccggcctgacctcattaattcttgtatgtatcggaatttatattgttaatcgggagaaccctttgaaagaagcatcgacaggtaagatttccgtgtagtttctttcaggctgctgcccatatcaagaagaagtgcctcaatgctttgcagggcactttctttttgctctggactatccacaagaatctctaattctaagaaagagccaagactctctacctggtctacgcaggcggtcatgcggcctttgtggtagtactggcgaagctttgtcactgggtatagctttttgtagccaagggagataagaatctcccttgcaatatcagcatcttcgatacgggtttctagttcctttcttgttgtggaaacggtgtcgagctttgcacccttgtaggtaagaaaggacgttgtttctctggttgtaaagttctcgcaggttcgtatgcggagtgcctcgtctgttttcataaagtcatgaaaatcgctggtaaaataaaaatcggattccttaacgagattccctgctttaaatccacagtctgtcaatgcccgttctgtgatggaccttcgaaacagtggcagtttaatttctacttcaatcatatacaagctccattaatattcatcaagagtaagtttataagttgtcttatcaagtttcagtgttaactgtttgtcctttaacgtgtaggaaagttttgtcttatccattttttcaaatattttgtaaagattactgtctgtgccaatagatttctcgcttaaatctttgtcgaaatgataggtaatcgtatgtttcttttcgttgatgtgtacttcaccggcaacgtattttggctcatcggcatcttcagccccgtctgttacatacagatataaagtatttgtatcaggattcatagtaaaataactgaagtgatcggaagagtcaaacttccagttaaaacaagtatcacaaagtctgtaagaatcactgtcactctttaatccataaattacattattgtaaaaagaaaggctctttccattgtaagataaagtgatggaatcatcctctgccttcatagtaatagtagattttgaaaaaccatctggcagatcttttaagaagtctggaagcttcatacttgcctctttataggtatagaatgtaaattcattatctctgcttgacaaatagaagaagtttgtaagaaaagttgcttctccttctgtagctgccttagggtcaatggaataaagctccatataattatcataaagacttaattcgtaagttgttttatcctcattgcttccgtcattgctgtaccacacatcattctccgcaaggtttaacagggggcttgccgagctgtttttagaagtttgtttggaagaatcgttttgcttttcaaaaaggtagctgacattatcataagtaagtaccagcttattttttgtcggcatatcgtaagacagtgtgctgccagaaccgaggccgtcccagccagaaggaagttccgctgtggtttcttctctggtatctaaggaaaacttttctgacttagcagagaggcttccggaaagacaggttttattctgtgcaatatctttgagagtaaatgttccctctttatctatagaaaaacttagatagtcacaactatagctgtcatctcttcctaaagcatttccaacaccattccaggttccaaccagctctgcaccatccttaccaagacttccggaaactttattaccacagccggtaccgacaagtgcaagtagtaaaagagtgaaaagtagtaaaaaatttttcttcataataggtcctttctgtgcgtagttgacacacaatttatatgatacgtcttagtttttgtaaaaaagacgtactttattctaccacatatcgggaagaagtaggagaaaatatctaaatctttttaaatatcttttttataattcaaaagtcctgttagttgcgtttgtgggtatcttattgtatactttataaatatacgctattaaatatgttttagattcaaaaggaggaccttgattcatgaaaatgatttcaatcgaaaaagaactgaaagagaattcttatccgggaagaggaattattgtcggacgttccgaagatggaacaaaggccgtgattgcgtattttattatgggaagaagttctaacagccgtaaccgtatttttgtagaggacggagagggcattcgcacacaggcatttgatccttctaaattagaagatccaagtcttattatttatgccccagtgagagtgcttggaaataaaacaattgtgacaaatggagatcagacagatactatctatgatggtatggacaaacagcttacttttgagcagtccttacgttctagagagtttgagccagacggaccaaactacactcctagaatttctgcagttcttcatttagaaaaaggtgagttcaattatgccatgtctattttaaagagcaataatggaaattcggaaagctgtaaccgttatacatttgcctataataaagttccagcgggagaaggccattttatttctacatatatgcatgatggcaatccattaccaagttttgaaggtgagccaaagtggatggcaattccggatgatatggatgcatttgctgagctgctttggagcagcttaaatgaagataataaagtatctttatttgtccgctatattgatattgcaacaggaaaatatgaatctaaaatcattaataaaaataaatgaaagcaatgtcgcggcacagtagtgttatcgaacgagaaccaaacttgccgaggttgggaagccccacctctataggtgggagaggatgtcacatagccatttaaatttgcaggagtttaaataattacattatacagaataaccgaaatcacaaagtcagaacataagtacatcataaaaaaagaggtaaaataagaatgaaagaattagagttaaaatatggatgcaacccaaaccagaaaccatcccggatttatatggaagagggagaacttcctattcaagtactgaacggaaaaccaggctatattaactttttagatgcttttaatggctggcagcttgtaagtgaactgaaaaaggcaacaggtcttcctgccgcaacttcttttaaacatgtatctcctgccggtgcagcagtaggtcttccgttaagcgatacactggcaaaaatctactgggtagatgatttgggagaactttctccacttgcctgtgcatatgcaagagccagaggagcagaccgtatgtcctcttatggtgacttcatcgcattatccgatgtgtgtgatgtttccacagctaacatgattaagagagaagtatctgatggtgtgattgctccaggatatgaaccagaagcattagaaattttaaaatctaaaaaaagaggcaactataatgttattcagattgacccggcttatgtaccagcaccaatcgagaaaaagcaggtatttggcattacatttgaacagggaagaaatgaattaaacatcgatgataagttctttgacaacatcgttacagagaataaagaactgacagaggaagccaagagagacttagctatctccatgattactttaaaatacacacagtcaaactccgtatgctatgtaaaagacggacaggcaatcggtattggagcgggacagcagtcaagaatccactgtacacgtcttgcaggccagaaggcagacaactggtggcttagacagtctccacaggtaatgggacttcagttcaaagatgaaatccgtcgtgcagacagagataatgctatcgacatctatatgggagatgagtacatggatgtacttgcagatggtgtatgggagaatactttcaaggtaaaaccagaagtctttacaagagaagaaaagagagcatggcttgataaacttacagacgtggcattaggttctgatgcgttcttcccattcggagataatatcgagcgtgcccataagagtggcgtaaaatatatcgcacagccaggtggatctatcagggatgataatgtaattgatacttgtaataagtatggaatcgaaatgtcctttacgggaatccgcttattccatcactaggattctgatttgccgagctggtgaggcagacgaaacagacgaacccagaaagagaaataaagcatatttgtgactttagtcgctgcaggttgaatgttcgcgtaaaagcgctcgcattcaacctttgctccgaggccacaaatatgctttatttctctttctgggttctgtttgttggcagctcagttcgggaaatcagttggagagatttggggaagaggacaggagacgtggaatgccgcaactatctgaaacctccctcaaattcctccaaaaataaattctgaatttgcttaggtagccaaagcacagcctacagggaatataatatcctatatttgtggcctcggagcaagtgttgggtatgagcgaataaagcgaatattcaacacgcagcgactaaagtcacaaatataggatattatattccctgtgggcgtctcttttgcctgcggcaaatcagaattatctattcatataatggaaagctgccggactcttcttcgttgaatacatagtatacagcgttttcctctggttttaagtataaatccatagtttttaaatcttttactttgcggtttttgttacctgcatctacccaaactttttttgcccttgcaataacttctttgctttcaatctgatttccagcaaattctacgttatatgttgatttcatttatgtattcccctttcctaatggaactattataatgtaatattgttacaaatatcatataataaattgaaataaaaatcaataaagaaatttcgacagggaaaaggcagacagtaagagccagagcgaatataattttggcagtcctgttttaccgttcataatattaaatgtcttggaatatttatgaattttttgcagataaatcttgcaaaatatacctttttcaactagaataaaaaaataaatgtgctctcacaaaagcaagtgcaagaaagacttcgagagtacatataaatgataggaggaatgacatatggttgcaattatagattatgatgcaggtaatattaagagcgttgaaaaagcgttgttacatcttggggaagaagtaatgattactcgtgaccgagagaagattttaaatagtgataaggtaattctgccgggagtaggagcatttggagatgctatggaaaagctccgttcttatggactcgataaagtgatttatgaagtggtggagaaaaagattccttttttgggaatttgtcttggtttgcagcttctttttgaaaagagtgatgaaactccgggagtgaagggtcttggaattttgccaggagaggttttaagaattccagataaggaaggacttaagattccgcatatgggatggaactctatcaaaatcaaaaaaggagcaaggctttttaaagatattccagaagattcttatgtgtattttgtacattcctactatttaaaagcaggacgggaagaggacgtgacagcaacgacagaatactctgcattaattcatgcttcggtagaacatgataatgtatttgcctgccagttccacccggagaaaagtagtgaaattggtttaaagattcttaaaaatttcgtggaattataaggaggaacttatgtttacaaaaagaattattccctgtcttgatgtcaatgatggaagagttgtaaaaggtgtgaattttgtaaatctgatagatgccggagatccggttgccattgcggaagcctatgataaagcaggagcggacgagctggtgtttcttgatatcactgcttcttctgatgcgagaaatacagtggcagatatggttcggaaagtagcggagaaagtatttattccatttactgttggaggaggaattcgtacagtagatgattttaaagcaattcttcgtgaaggggcagataaggtatctgtcaattctgcagcgattatgcgcccggaattaattagcgaggcagcagataaatttggaagccagtgcgttgttgttgcgattgatgcgaagcgaagagaggacggcggctggaatatatttaagaatggcggaagagtggatatgggaattgatgctgtagaatgggccatgcgtgtagaaaaactaggagctggtgaaatccttcttacaagtatggactgcgatggaacgaaggcagggtatgatttagaacttacccgcactatttctgaaaatgtttctattcctgttatcgcttccggtggagctggaacgaaagaacatttttatgatgcatttgatcagggaaaggcagatgcagctttggcagcttctttattccattttaaagagttggaaattatggatttgaagaggtatcttagagaaaaaggaatttctgtgagaatataagcggtatttttatagatgatagcagaatgtgttttgtttaggaagtatttttcatccgatatagagcatgtttgaaaggccattcctgcaatctgcataccccaatttgcagagagcattttttgaacatgctctcggaaatttaatgaaaattttgggattacaaatgattttaaaatctgccggaatgaaaggaaacttattatgaaacttgcaaagggagataaagttgcaattgtctgttgttcgaacgggcaaagtctgtcaaagaaaaaggagatagagaacttaaaagtaattttagaagaaatgggtcttatttccgtattttcaaaatatatttatcaaaagatttctttagaagaggtagaaaataatttaaaaggttttccagaaagcggaagtccattagaaaaagcgagagagttgatggaattttatgaggatgcttctataaaagctattttcgatatctctggaggagaccttgccaatacgatacttccttatctggattatgaacgaattgcctccgtaaaaaagcaattttgtggatatagtgatctgaccactattataaatgccatatatgcaaaaacacagaaggtctctgttttgtatcagattagaaatcttttgtatgaatattccgcgcagcaaaaagaagactttataaaaacgtgttttgcaaaagacttaaacaacataataaacaatgatgcagtaaaaatgatggaaaagaacaacctctatgatttatctgtggaaaatagtggactatatcagttcccatataaattctatcagggaaaaacggtagagggaattgttgttggaggaaatattcgatgctttttaaaactggcaggaaccgaatattttccagatgtcacagataaaatattacttttagaggcaagaagcggaaatccagcgcagattgtaacatactttgctcaattagaacaactgggcgtattcaaaaaagtaaaaggtattttacttggaacatttacgcagatggagagagaacagccagtgtcggctgtatattctcttttaaaacgatacattaatgaagaacttcctgtggtcaaaacggagtatatcggacatggagaagattctaaagcaatacaaatcggaaagaagtataaattctaagttactgcaggcaaaatagacgctctcaaagagaaaaaaatggttcagagcatgcttaaaaatgattcaaaaaaatttattcaaaaaaatttaaaaaagttattgacgaatttgttttttatgctataatgttagacagtgcaaaaatacccagacagttgtattaggcacaatacgcaactggagggaggttaggtgagtcaatgtcaagtattatcgttaaagaaaacgaatctttagacagcgctcttcgtcgttttaagagaagctgtgctaaagcaggtattcagcaggagattcgtaaaagagaacactatgagaaaccaagtgtgaaacgtaaaaagaaatctgaagctgctagaaaacgaaaatataaataagtgctgtaaggggacatccagttatggatgtccttttttcatgctgtcaatagacggctgctaagaaagaatatagcctatatctgtgactttcgtcgcgtcgcgttgaatgttcgctctagcgctcgcattcagcacttgctcccaggccacagatataggctatattctttcttggcggcctgttttttggaagattgaaaaaggatatccaggggagatttgagatttagaaatttagatttctgcttgctttggaattggtagaatgtggaaattgtgatcttgaattttgccaaagacagaagtctgggaacaaatcaaattagacataatcatgattatgtaaagttcacaaaagaaaaactttcttttgtgaatagttattcaaaatatctttaaaaatgcataaaatcaattgaccgatttatgcaaaagtgatattattgaaattaggatgagtgtggtgattggcacataatcccaatgatatattatttctttgaaggaggagattattttgaagaagattattaatgcagtagaccaggtagagaatcagatgatagaaggtatggttaaagctttccctcagtatgtgaagaagcttgactgtggtaatgttgttgtcagagctgagaagaagactggcaaggtagccttgatcagtggtggcggaagcggacatgagccagctcatggcggatttgttggaaaaggtatgttagatgctgcagttgcaggtgctgtatttacttctcctactcctgatcagatttatgaaggaattaaagccgttgacgatggcaagggcgttttaatggtagttaagaactatacaggcgatgttcttaactttgagatggcagctgagatggcagccgatatggatggaatcgaagtaaaagaagttgttgttaatgatgacgttgctgtacaggattccttatatacaacaggccgtcgtggtgttgccggaacagtatttgtacataagatcgccggtgctttagcagaaaaaggtgcaagccttgacgaagtacaggctgttgctcagaaagtaattgataatgtaagaacaatgggtatggctattaagccttgtaccgtaccagcagctggagaacctggatttgaactggctgatgatgagatggaaatcggtattggtatccatggagaacctggcgttgagaagaaaccgcttgagacagcagatgaaatcgttgatacacttcttgagaagattttagcagatatcgactactccggttctgaagtagcagtaatgattaatggatgtggatctactcctttaatggaactgttcatcgttaataaccgtgtagcagatgttttggctgagaaaggtatcaaagtttataagacaatggtaggcgaatacatgacatcccttgagatggaaggattctctatcacattactccgtcttgatgaccagatgaaagaactcttagacgaagaagctgacactccagcacttacagttgcaaaataataagtgaaatagatagctgttatctaaggacggttattgacataccgcccttagacggttacaatgaatttaacgaaagaccggcgtaatctgcgtgggtcttttgttagagtaatgaatattaggaaagaggacacaattatggcagacgtaaaaaagtaattgaaatcattgacaagattattgcagatgtagatgagcagaagttgtttttaacagagcttgataatgtaattggtgatggtgaccacggtattaaccttgctcgtggttttgatgcagttaagacaatcgaagatacatttgaaagcaaagatatcggagctattttaaaagcaatcggaatgaaacttgtttctacagttggaggagcttccggtccattatacggaactgcatttatgaagtctggtgcattacttaatggcaagacagagatggatatgaatgattttatcgagatgcttcaggtatccattgatggtatcatgaaacgtggtaaagctgtaaaaggtgaaaagactatgcttgatgccatgattccagcacatgatgcaatcaaagcttcttatgaagcagacggtgatgctaagaaagctttagatgcaggcgtaaaagctgcagaagagggtatcgaatatacaaagacaattattgcgacaaagggtcgtgcaagctatcttggagaaagaagtatcggacatcaggatccgggtgctacttcatttacattaatgcttaaagcagtacaggaacttgcataagagaaaggaataagatatatggtaggtattgttgttgtatcccacagcccaaaattagcagaaggtgttgtagaattagcttctttgatggcaccggaaacaccgatgaaggcagccggtggaatggatgacggcggatttggaactagttttgaaaagattacagaagctattgatgaagtttacagtgatgacggtgtagcaatctttatggatttgggaagtgctgtcatgacaacggaaatggttttagaatctatggaagaccgtaagattaagatggtagactgtcctgtaacagagggagcgattgctgccgcagtagttgccgcaggaggagcttctcttgaagaagttgtgcaggtagcgcaggcatcgaaagaacaggccaaattctgatttgtaaggctgtgaaacagacgccagcaaagagagcctatccctatatttgtgactttagtcgcggcggtttgaatactcgcttacacacactcgtatccaaaccttgctccgaggccacaaatataggggataggctctctttgctggctgccttgcagctgcgcaaatcaggagttctattttttctttctctctcatagggatataaaaaatacatggtgtgattttatgctggaaaggaagagtccttttgtctgttctgtaaatggagccaaagaaatcagtatagaaaattatggaagtctgggtgatttcagtgataaaaagattgtgttgaattgttataaatgtaagatgattattgagggagaaggtcttttaattgaatattttaccgatgttgatatgaagattacaggtcatattcattcaattcatttttgaagggagaagaagatgctcttttcgttatttcattttctgtcgggatattgccggattgttttaagtgggatgaatcaggaacgttttttaaatctctgcgcagcaaagcagattcttttgtggaatattaaaagagagggaaagcattatattttttacataagcagagggggatataaagaacttcaggaaatatcagaaaaaacgggaagtacatttcggtgtatacagaaaaaaggaatcccgtatttgttctgcagatataaaaaaagaaagtgctttgcgttggcacttttgttttgtacagctatttttattgttatgtcctgttttatatggcaggtgcaggtgacaggaagttatggacattcagaggaagagcttcttgattatcttgagaaaaaaggagttcatagtgggacaaagatttcagggttttcgtgtgcacgattagaggagcagattcgaaaggattttgaagacatagcatgggtttcctgtgaaagaaagggaacacttttaagagtcagagtgaaagaaactttagataaacgtgatcaaaaggagggagaaatgcaggaatcaccatgtaatcttattgcttcaaagaaaggaagaattgccagtattcttgtaagaagcggaagtgcaaaggtgaaaaagggcgataaagtaaagccgggggatgtacttatttcagggattgtagagattaaagatgatgagggagaaattgcagaggaaacattggtaagggcacagggagatgtttatgcaatttcaaaaataaaatatgaagattgttttccattaatttattataaaaaaaattatactggaaagacagaaaaaagttatcgctttttgataaatggttatacgattaaaatgccggaacgtaaaacagcatatgcagagtatgatgaacagtccagagaaattttgctgcatatcggaccacagttttatctgccggtttctctttttgttataacaaaggcgcagtgtcagatttcaaaagaaagttatagtgtgtcccaggcaaagaaggaggcaaggaagcgtctttttctctttttgaaagaatatgagagaaaaggggtggtaatcctgaaaaataatgttagaatagacagtgataaaaatgagtgtactgcaaggggaattatcaaaataaaagaacgtgtaggtaaagttcaggagattccctcaacattagacggggaaaaggatataaaacaagagcctgccgttttaaacagataattttagcagtaagttcaattacaaatcatatagtgggattttgaaaatatattgacaagaaaggaaaatcagacaaagaatgaatatagcagaacaggaattcccttttccagcggaacatgcaagtaatgtttttggtcagtttgatgccaacatgaaaaagattgagaagacattgcatgtcacgattattttcagagatgacaagttgaagttaattggaggagagaaggattgcgatagagcaaaacatgtgatagagcagctccttttattatcgcagagagggaatgatattacagagcagaatattaattatacactttctctttctatgacgaatgaggaatctgcagttacccagttagatagtgatgtaatctgtcatacgatcatggggaaaccgattaagcctaaaacgatgggacagaagaaatatgttgatatgatcacggataagatgatcgtatttggtgtaggacctgcgggaaccggaaagacatatcttgcgatggcaaaggcaattacagcatttaaggcaaatgaagtgaatcgtattatcctgactcgtccggcgattgaagccggggagaagctgggatttcttccgggtgaccttcaaagtaaagtggatccgtacttacggcctctttacgatgcgctttacgaaattatgggtgcggatacttttgctaaaaacatggaaaagggattaatagaagtggcacctcttgcttatatgagaggaagaacgttagataatgcatttgttgtgttagatgaagcgcagaatacgacaccggcacagatgaagatgttccttacccgtattggctttgggtcaaaggcaattattaccggtgaccttacgcagaaagacctgccgtcaggtactcgttcgggtcttgatgatgcgcttcatgtgcttaaaaatattgatgaaattggcgtgtgtaatctgacgagtaaggatgttgtgcgtcatccgcttgttcagaaaattgttaccgcatacgatgaatatgacaaaaagaaagaaacaagacaaaagagaaagcagagaacaacaggaaagcaggagaaaaaatgacatttgaaatagagaatgtatatccggaagtgattttaccggattatgaaaccgttattaaaaatgtgatagaggcagccttagattatgaaaaatgtccgtatgaagcacaggtatatgtgctcttaacagataatgaggagattcatgagattaataaggaacatcgccagattgaccgtccgacagatgttctttcttttccgatggcagattatccggtgccgggagatttctctgatatagaagaaagagatccggatgcttttcatcctgagactggcgagctgattcttggagatattattatttccatggataaagtaaaggaacaggcgaaagcttacggtcattccaatacaagagagctggcatttttagttgcacacagtatgcttcaccttatgggatatgaccatatggttgatgaggaacgaaaagtgatggaagcaaagcaggaagagattcttaaaaactgtggttatattcgggagatggaagcttgagacaaataaaaggcagggaaaaaactcaggggaatagcagaaaaagtttcacaaatgctaaagagagaaaaggcagaatcagagagcaggaaagtgccggccagttaaataataaagcgaaaacacagaacaatatcagtctgtcaaagaacagaataaaaacagagaaaaggcacaatcagaggatggcgaaacaaatacaaaaaagtactgtggaaaaggacaggatattaccagaaaaattaattcaggattccacagtatgggataccattattgtcggagctggagcagccggaatgacagccgcacttgcctgcggaaaagaaaaacaaaaagtactccttcttgatcgccaaaaccagatgggaagaaagattctggtcactggaaatggcaaatgtaatctcacaaactttgcacaaaagccaaaatattatcgaagtgactgtccagagaaggtacagaaagtattgtctgtgtttggacaaaaagaggctatggagttgtttcagagtcttggaatctatacaaaagataagaatggctatgtgtacccatacagtgagcaggcggcaagtgtgagggaagcttttgagacagaaatattatcaaatccgtctattacatttgttcctttttcggaggtatacaatgttcaaaagaaagaggacgtttttttgataaaggcaaaagaacagctcggtcagtcagaacagagtacaggaaagcagggtaatggtgagaaaatagaaaaggtttatcgctgtcagagtctccttgtcacaaccgggggatttgcggggccgaagtttggctgtgatggcagcggatatgcatttgctaaagtatttggacatgagattataaaaccattgcctgcacttacagcattgaagtcatctgctccgtttttaaaaaaggtaagcggggttcggaatcaggcagaaatcacattagaaattgatggagagccggtaaaaaaagaaactggagaacttcaatggacagactatggtatttctggtgtggctattttccagttaagccgttttgcgatcaccgctttagaggagaaaaagaaggtagctttatactttgactttatgccggaactttcttccaaggagaagcttcgcctgtttttgatgcttgcacaaaatcataaaaaaagagacatgctttcttttgtaaaaggactatttcctgcaaaactttgcccggttattttaagagaggcaggattaagagaagaaactttagctggaacattgaaggaagaagaatggaatgcccttgtcatggcggtaagtcattttcctttgcggattaatggttatatgggatatgaaaaagcgcaggtaacaagaggcggtatttctcttacagaattaaccggtaatttagagtcagattttcagcctggactgttttttgcaggagaagtagcggatgttgacggcacctgtggaggctataatcttcaatgggcattttcgagtggtacagtagcaggaagagcgattgttaagagaaatcaggagctttttaaggatgaccggcatacgatggaagaaaacgatggtatttcagaaaggaaccgaagaagatgatacgaatttcacagttgaaattaaaggtgggacataccagagaagaactttttgaagagattattcatcaggcgcatgggaaaagacctgtctcatggcggattgtaagaaagtctgtggatgcaagaaagaagccacagcttttttatgtgtatacaattgatgcagagtttgaaaatgaaaaaaagcttctttcagccaaaaaaagtaaatggacacgttctactgtagtgaagtatagatttccatataataagaaagatggatcaggagcaagctcgacagaagtttcgacaatagacagggcagttattgtcggtatgggaccagcaggactttttgcagccttagttcttgcaagagcaggatttgcccccattgtatttgagcggggagactgcgtggaaaaacgttcggagattgtcgagcatttctttgaaagtggagaacttgatgaagagtctaatgtacagtttggcgagggcggtgcaggaacattttctgacggcaagttaaataccttagtcaaggataaatttggacgtaaccattttgttttaaaagaatttgtcaaacatggtgcaccagaagaaatcctttatgaagctaaaccacatattggtacagatattttaaaagatgtggtggcatcaattcgaaaagaaatagaaagtcttggcggggaggtacatttccgcacgaaagtctgtgatatcttatgtgaaaaaatcagtggttctgtggcagaaagagagagagctgaagcagaaaaaaaacttttgatgcaggacaaacagctaacaggacttattcttgaaaaagaaggagtgcaagcggaatacccttgccgcaatgttatttttgcaatcggtcacagtgcaagagacactttttatatgcttcatgaaagggaactttctatgaatccaaaagcatttgcgattggtgtgcgtgtggaacatctggcacatttgattaatgaaagtcagtatggagagggatatccagaggaagttccaacagcaagctataaactgacgcatcagtgcaaaggcactggcagaggaatttattcgttctgcatgtgtcctggcggttatgttgtaaattcttcttcagaaaaaggtcggctttgcgtcaatggaatgagttaccataaccgggcaggacataattctaatactgcattgattactacagtgacgccagatgatttcccatcagatagtccattagcaggattggaatttcagcgtaaatatgaggaacttgcttataaaatcggaaatggaaagattccggtacagctttttggagactttctgaaaaatcagatgtccacaaaacttggaaacgttactccgtccataaaaggagaatggcagttcgcaaacttacacgaatgtctgccagattatgtctgtgcatccctcgaagaaggaatgagagccttcgggcataaaatcaaaggctacgatgcagaagatacggttttttccggagtagagacaagaacatcttcaccacttcgtatggaaagaaataaacagtttgaaagtaacatacaaggtctttttccatgtggagaaggagcaggttatgcgggaggaatcacttctgcagctatggatggtattaaaactgcagaagctattgcagagaagattctcacacagaattaagtacagccagcaacgagacaaagcttgactgcatttacttacaaagatatttctgtgtttacaaacgtaggaccattgtgtataatacaacggaatgtactctcggagtctttcttgtacctaattttgtgagaagattccgagagtatatcggattaaaaaggaggaaattttatgaataatattgatattgatagaattaatgaactataccataaatccaaatctgtaggacttaccaaagcagaagaagcagagcagaaaaaactccgcaaagcttaccttgctgccatccgcaaaaacttgcgtggttctttgaaccgaattgacattcagaataaagacggaagtatcgaaaatcttggtgagaaatatggaaagaagctggataaaaactaaaatgccagaagaagctttagaattaaaaaagaatctgcggtgtgatatgaaagcaagacgaaatgcattgacagatgaagaaaaaaaacatgccgcagcaaactgcctgtcaaaattaaaagaactgccggaatttatgaatgcagactggatatatgcctatatcgcctgccggaatgaattagaaaccgcagacatcattagctggtgtctttcttatggaaagcatgttgccgttccaaaagtacaaggagaaatcatgcatttttacgaaatcactgcgctatctgactgtgttcccggagcatttggtatccttgagccagcaggagaagaaaaagacagaatcacaactccaggctttatgcttgtcccaggacttgcctttgataaaaacggaaatcgtcttggatacggcggtggattctacgataaatatctcgcatcccatgaggagattataacagcggcattggggtacgactttcaaatcgtagaaaaagtaccgtccgaatcccatgataggaggatggactatttaatttattaggcaaaacagacgccctcgaagagaaaagcgcctctatatttgtgactttagtcgcggcggtttggatgttcgcttatgcgctcgcatccgaaccttgctccgaggccacaaatatagaggcgcttttctcttcgagggctgtctttggctggatttttaaattaaatagtgcatgggaaagatttgaggttgaaatcggaagtctctcatccccaaattactcccaactaatcagccatcggttttgtgaaggttataaatatttgtcggattgtctgatgtaaataaggaagatattcttccatggatactggctgctgatataagatgcagctatagcaggtagagcctaccagctctaagattgtaaagagcattaattcctgattttcgcagaagatatgattctgtgtcagcatatcctgatagtaatcataaaattgtcgggaattttccgggaccgtcttctcaaaagcatttttaaagattccccaggaaagattcttagagatgaactgaagaagcttcggttctttttctaatcggtctataatatgatcaatgacgaaaaacatctggttttcaaaaccctgaatattctgttcgattaaagccgtatgtgcattcccaaaaagctggcttgttttatatgttacaagcttgtctcttaaatcatatttatctttaaaatataaatagaaagttccttttgcgagacctgcccgatttacaatgtcggaaatggttgttttagtaaaccccttttcggtaaacagttcaaaagaagtctgcaataatgttgtattcttttgttttttatttgtctcaacttttcccataataataccaccttaaacgatgctgaatgtatttggctacattatgcaacaaaaatgaccaaaagtcaataacgtaaaaatgaccaaaattcagtttcgcttattgaggaaaattgtgcgttactcagtgttgaccgatggtcattttttgcatataatgttggttaggaaaagaaaataaataaagaggggatgatgaatttgttaatcaagatgggtaagcagattgcgaaacataaatttctgattttgcttattggatttttgttactgataccttccttaataggaatggtaacgacaagagttaactatgatttacttagttatctgccagagacgcttgaaacggtaaaaggtcaggatattatggtagatgagtatggaatgggagcgttctcgatggttgttgtcgagaatatggaactgaaagatgtgcagaagcttgagaagaagtttgaggcagtcgatcatgtaaaggatgttctctggtatgatgatgttgctgatttaaatcttccagtacagatgattccgaaaaagttaagagaaggtttctttaaaggcaatgccacgatgatgatcgtacttttcgataatacgacatcatccgatgaatctatgaatgcagttgccgagatgagaaagcttgcgaataagcaatgctttatcagtggtatgtcaggtgtagttaatgatattaaagatgttgcacttgacgagctgccagtttacgttgtgattgccgctgtattgtcattcctggtacttgagtttacgacagaatctttcttagtaccagtgttcttcttattaagtatcggaattgcaattatttataacttaggaagtaacgtgttcttagggcaggtttcctatattacaaaggcactgacggctgtattacagcttggagttacgatggactattccattttcctgctgaatagttatgaggaatataaagagaagtacacagaagataggaaccgggcgatggggcatgcgattgcaagtacctttaaagcggttgtcggaagttccgtcacaactgttgccggatttgcggctctttgctttatgacatttgcattaggtcgtgatcttggtattgttatggccaagggtgttattatcggtgtaatctgttgtgtaacgattcttccatcactgattcttgcatttgataagcagattgagaagacaaagcacagaccgctgattaagagtgtggatggtgcatcaaactttattatcaagcatcactgggtatggctgattgttttccttgtattattacttccagcagtacatggaaataataatatcaagatttattatgatatcgcaaagtctatgccatccagcctgccaagtaatgtggcgacagaccgattgaaaaaagactttaatatgagtacgattcatatggtaatgatggacagtaacatggattctaaagataaacgagatatgctcaaagagattgacaatgtagaaggtgttaaatggacgataagcatgagttctcttgtcggggcctctgtaccagaatccatgattccaaaagatgtaaagagtatgctccaaagcggtgaccatgaactggcttttatctgttcggaatatgaatcagcaactccgaaagtaaataagcagattgcaaagattaataagataacgaagaactatgataaaacatcaatggtaattggtgaagcaccacttatgaaggatcttgaagatgttacaaacattgatatccagaatgtaaatattgcttcaatcgcagcgatttttgtaattattcttattatatttaagtcaatctccctgccagttattctggtagccatcattgaatttgcgattgcggtaaatatggcagttccatattaccaggggtcagccttccatttgttgctagcattgttatcggaacgatacagcttggagcgacagtagactatgcgattgtttataccaatcgttatttgaaagaacgaaggaatggaaagaataagttagaggcaatcagcattgctcataagtcaaatatgctttctattataacgagtgcgttgagtttatttgcagcgacttatggtgttgcctgctactcacaggtagatatgattggttctatttgtacattgctggcaagaggtgctattatcagtatgatcgttgttctcacactgctgcctacgatgttccttatctttgataaggcgatatgcaagacaacgaagggaatgggccatattgacgatcataaagatacagtagttaatgacattgtattataaataatatgtaatcccggaatctaatggaagcaaagcgtcatatgctgtacaaaagattccaggagcataaatttagggagtgatagagatgagaaataaaagatttgtaaaacacacatccagagcatttgctattctcatgagtgccatgatggcagtaggaattgcaatgccagtcaatgcagcaggaaaaaaagattccaaaaaagaagataagacagagacggtatatgtaaatgcgaatgcagacggaagcgttgataagattactgtaagcgactggttaaagaatcatagcagcagtgatacattagaggacttttccaacctcgagaatatcaagaatgtaaaaggtgacgagacatttacccagaatgcagatggttctattgtatgggattctaaaggaaatgatatttattatcagggcgaatccaatgaagaacttccagtaacaatgaaagttacttattatcttgacggacagcagatggatccgaaagatatggctggtaaaagtggtgaagtaaagatacgctttgattactataacaactccaatgaaacggtaaaagtaaaaggcaagaactataatataaagactccatttactatggttaccggaatgattctttcttctgatgtattttctaatatcgaagttactaatggtaaagtaattagcgatggagataaaaatgttgttgtaggtcttgcgttccctggattaaagagcagtcttaatctggcatcttatgataaattagatgatgtagatattccagaatatgtagaagttacagcgaaggcagataagtttgaacttgcattaacagcaacagcggcaacaacaggaacattaaaagacattgatacaagcaatttaaatgacgtagatgatttaaaagacagcatggataaacttacagatgcaaccgataagctgattgatggaagtgaagctttatccgatggaatgggaactctttcttcttcagcaggagaatatacaaagggcgtatcttccgcgaatgctggagtaaagcagcttctatccggtcttaatacattaagttctaagagtggacagttagaatctggtgtagaatctttgaataaaggattaaaagccctgaaaaagggaacaaagtcactgaatgcaggaatctcctcctatacaaaaggagtatctggcttagatgctggtttacagtcagcagcaagcggtacaggtaagttagagtcaggagcaggagcactttctaaaggtattaaaagttataccgaaaatgaagctaaaattgcagcaggaatcaaaaagttaaataataaggtttctggaatgagtaatttggaactgccaagtgacacagaattaaaagcagtaaagaaggcatcctctgcattagaaagtgacgcgaaaaagttacaggaatcggcaacagagattcaatcggcaattgataagatgaataagttatctgaagcagtggaggcgcacaatagtaagatagatgaacataataaagaagtttcagagaagttcagtagtgcaaaatctgcattagatgatattgataaaaaggcaacggataaggcaaatgaaaagattgccagccagaaagattctcttagcagcagtgcaacttcaaaggcaaaagaagaagctaaatctgccattgatagtgtaaatatggatggattgaccgatgaaatgaagagtgctttaaagagtgccattgataataacgttagtgtaagtgcagagccatcaagcattgaaatcagtggcctggcaagtgatgccgaaaaagcattaggagatgctccaagtgcagagaagcttaatattggcaaagttaatgtaggactcagtgatatggaaactctgttaaaagatatgaagacacaggcagcagtattagagagttttgcagcaaatacaggttctttatccgatgcagcaagtcagattccagatttgatcaagggtgttgatgaattaaataccggagcgcaggctcttactgcaaataataaaacgcttacaagtggtatgaaagatttaacttctggtcttagcaccctttctaccggacttgataccatgacaaaaggagcggcgaccttaacaggcaataacagtgttcttacaaaaggagcaagttccgtagataaaggaacaggtaagttagtagcgggaagcagccagttagtaactggtgtaaaggcttatgcacagggggttaatgcagcagcgatcggtgtacagagtctttcttctggaatgaataagttagactccgcaggcggacagcttacttctggtattgataagcttgctacaggaagcgatacacttacaaaaggcttaaagacatttaatgatgatggaatcagcaagctttctgaccttgcaggagatgatcttgacagcgtgatcaatcatttcaaggctgtaaagaaggcagataacagatacaaatccttcggcggaattaagaaaaatgcgaagggaagcgtgaaatttgtgattgaaacagaccctatcgaggcagacgagaattaagaaaatgtcacaaaaatagcagatagcaggtaaaattttaagaaatcccttgataaacaatggaaaacctgctatactacgaatagtatactgtagatgataagagtgggtgggtgcccactcttattgtatgtctgggaaagaggtgagaatcaacatgaaaagaacagagattgttgcaaagacggaagaactggtaactccgattattgaggagaatcattttgaacttgttgatgtagagtatgtaagagaaggtgcgaactggtatcttcgtgtatatgcggataaggaaggcggcattaacattgatgactgcgtactgatcagtcgtgctcttgaagagaagcttgatgcagaagactttatttctgatgcttatattttagaagtgagttcccctggtcttggaagaccactgaaaaaagagaaagattttaagagaagtcttggaaagtctgtagaatgtaagctctacaaagcaattaataaacagaaggaatttgagggaatcttaaaagatttcacagaagatactgttacgattgaaacagaagggaacgaactggtacttgaccgtaaggacattgctatgattcgtttagctattgatttttgagaataatatagaaaagaaagcaggaggataagagaaaatgagtgaattaattgatgctttaaatcaattacaaaaagagaaacatattgaaaaagaagtaattatgcaggcgattgaagattctttagttgcagcatgtaaccgtgactttggaaagaatgccattgtaaaggtaaacatggatagagacactggtgatatttctgtttatgtcgaaaagacagttgtagaggaagtagaagatccagctacagaaattagtttagcagatgcaaagatgattcgtttccactatgagattggcgatgtagtaaacatcgaagtgactccaaagaacttcggaagaatcgctgcacagcatgcaagaagtgttatcgtgcagaagattaaagaagaagaaagaagagtggtattcgagcatttcgcacataaagaaaaagacatcgtaacaggtgtagtacagcgttataatggaaagaatatcagtgtaagtcttgacgataagacagatgctgttctcacagaaaaagagcaggttaaaggcgaagtatttaagccaacagaccgtatcaaactgtacatcgtagaagtaaaagatacaaacaagggacctaagattttagtttccagaacacatccagaacttgttaagagactttttgaaaaagaagttgcagaagtttatgatggaacagtagaaattaagagcattgcccgtgaagcaggttcccgtacaaagattgcagtagcatctaacgatcctaatgtagatcctgtaggagcatgtgtaggtattaacggagcgcgtgttaatgcaatcgtaagtgacttacgtggagaaaagattgatattattgaatggaatgatgatccagcagtattgatcgagaacgcattaagcccatccaatgtagtctctgtagatgtagacgaagaggaaaagagcgcacgcgttgttgttccagactaccagctttcacttgccatcggtaaagagggacagaatgcccgtcttgcagcaaagcttacaggatataagattgatattaagagtgaaagccaggcagcagagcttgcagaagaattagacttcggagaagattttggtgatcttgatgaggcagaagattttgaccttgaagcacctgtagaagagccagaagtttccgcaagcgaagcgacagcagattttgaggcagaagaggtaacagaagaaccagaaacagcagaggattcttttgaggaagtttcttctgaggaagcagacacagacgaacagtaagaatggaatctggtgaacagttatgggaaagaagataccacttagacagtgtgtgggctgtcgtgaaatgaagacaaaaaaagagatgatccgggttatcaagacaccggagaatgaagttgtccttgatgcaaaaggaaagcagaatggcagaggtgcatatctttgtttttctgcggagtgtcttcagaaagcaagacgttcaaaaggactggaacgttctttaaagatttccattcctgatgagatatatgaccgattagaagaggagttgaaggaacttgacacaaaacagtaaagtattatctatgctagggcttgctgctaaggcaggaaaggttgccagcggagagttttctaccgaaaaggaagtaaaatccggcaatgcctgtctggtaatcgtagcagaagatgcttctgacaatacaaaaaaattgttccggaacatgtgtaagtattatgaagtgcctatggaaatctttgcgaccaaagaggaattagggcattggataggtaaagcgtacagggcttccatctgtatcttagatgaaggttttgcaaaatcaatcgtaaaaaaaataagtctgaatatggagggatagtgtatgccaaaaatgagagtacatgagttagcaaagttattagataaaagcagcaaagaaattatagcagagttaaaacagcagggagttgaagtacagagtcatatgagtacagtatcagatgaacatgtagataaattaaaagcaaaattccagaaaaaagaatctggtaacaaccgcggtaacaatgaaagccgtagcaacgataatcgcggtagcagaaatgataaccgtggagatagaaataataaccgtaatgacaaccgtggggacggaagaaataacaaccgcaataacgacaatcgtaatggacgtaatgaaaaccgcggagatggaagaaataataaccgaaatgataaccgtggcggccgtaacaaccgtaacgacaaccgaaatgacaaccgtggcggcggaagaaataataatcgtaataacgacaaccgtggcggccgtaatgataatcgcggagataaccgtaacaataaccgtaacggaaatgacagaagaaacaggccttctatgggagatactccgattaacgcaaaagaaacaagaaacggcaaagaaaaccgccatgacatcaatcgtgagcacagccgtgacaacaaggaaaacaaccgaaatgataaccgtggtggcaagaacaaccgccgcaataaccgcaataatgattttggcagctcaagaaagcagaagaacaataagaagcagcaggctccagtacagccaccaaagcaggaagagccaaaggaagatgtaatccgtaacatcactctcccagatccagtatccttaaaggatttggcagatgcttgtaaggttcagccttctgttattatcaagaagcttttcatggcaggacagatggtaaccatcaacacagaattctcttttgatgatgcagcagaaatcgctttagaatataactgtatcgcagaggaagaagtaaaagttgatgtcatcgaagaactcttaaaagaggaagaagaggacgaaagaaacttaacaagcagaccaccagttgtctgtgtaatgggtcacgttgaccacggtaaaacttctcttcttgatgcgattcgttccacacacgttacagcaggtgaggctggtggaatcacacagcatatcggcgcttatgtggtagagattaacggagaaaagattacattcttagatacaccaggtcatgaggcatttacttctatgcgtctgcgtggagcacaggcaacagatatcgctgttttagttgttgctgccgatgacggtgttatgccacagacaatcgaggcaatcaaccatgcaaaagctgcagaggtagaagttatcgttgcagttaacaagattgataaagaaggtgccaacgttgaccgtgtaaaacaggaacttactgaatacggccttatcgcagaagactggggtggaagtaccgtatttgtaccagtttctgctaagacaggcgaaggaattgatgaactcttagagatgattactcttacagcagaagtattagagctgaaagcaaacgcgaagagaagagccagaggtcttgttatcgaagcgaaacttgataaaggccgtggaccagttgctacaatccttatccagaaaggtacgcttcatgtaggagacagcattaacgtaggtcatgcatttggccgtgttcgtgcgatgatggatgacaagggtaaccgtgtaaaagtagcaggcccatctaccccagtagagattcttggtcttaacgatgtaccattctccggcgaggtccttatggctcacggaaatgaaaaagaagcaagagcaactgctgatgcatttatcgcatatggaagagaaaagatgctcgaagagacaaagaataagttgtcccttgatgatttatttgatcagattcaggctggtaacgtaaaagaattaaaccttgtcgtaaaggccgatgtacagggatctgtagaagctgtaaaacagagtcttatgaagctttccaatgaggaagttatgattaaagttgtacatggtggtgtaggtgccattaacgaatctgatgtaatcttagcttctgcatctaatgcgatcatcatcggatttaatgtacgtccagatgcgatggcaaaggctgcagcagagagagaaaaagttgacatgagattataccgtgtcatctataacgcaattgaagatatcgaagcagcaatcaagggtatgttagatcctgtttacagagaaaaagtaatcggtcatgtagaagtacgtcagatttacaaagcttccggtgttggaacaatcgctggatgttatgtactggatggtacgattacaaaagacgcacagtcccgtatcgttcgtgatggtatcgttatttacgaaggagaacttgcatccctgaaacgtttcaaagatgacgtaaaagaagtaaaagcaggcttcgaatgtggtatcgtttttgaaaaatacaacgatattaaagaaggcgaccagattgaagctttcgtaatggaagaaattcctagataacaggaggtactgttatgagaaagaacagtgtaaaaaatactcgaattaattccgaggtattaaaagaactgagccgtattatttccagagaaatcaaagacccaagaatcgctccgatgacttctgttgtgtctgtggaagtagctccggatttaaagacctgtaaagcttatatcagcgtactcggtgataaagaggcacaggaatctactttagaagggctcagaagtgctcacggttatatccgccgtgagttagcaagaagtattaacttaagaaatacaccagatgtccgctttattcttgaccagtctattgaatatggcgtaagtatgtcaaagaagattgacgagattaatgcagcaatgcatgagagagaaagagaggcatcggaagaatgagtacagacaagagagaaaatgtgacatttgccgaaagaaaagaggagtttgagcgtcaggttcagactgcacagacaattgccatatccggtcatatgaatccggacggggactgcattggttcctgtctcggactctatacctacattgtggaacagtatccagaaaaagaggtaacattatttttagaaccggtacaggataaattctcatttttaaaatatgcggaccagattacacaggaaaaaaagattgacggaccgtatgacctgtttttttctcttgactgttccgatacagatcgtctccatgatttcaaaggttattttgaagaggcaaaatacaagatatgcgtagaccaccatttcactaatgagggatttggtgacttacgctttatcgtgccggacgcttcttccacctgcgaagtattgtttgatatgtttgactgggataagatttcccttgaatgcgcgcaggatctttacatgggtattgttcatgataccggtgtattcaagcataccaatacaacaagaaaaacgatggagaccgcaggtgctttacttgaaaaaggcattcattctgaagatatcattgaccggacattttacaagaagtcctatgtgcagaatcagattcttggccgtgcattaatggaaagtatcattcttttgcatggaaaggttattttttccatcgttcgaaagagagactttgacttttatggaatcgacagcagcgatttagacggaattattgaccagcttcgtgtgacagatggcattgaatgtgcgattctcctttatgagaaagaagatggtaactacaaagtcagtatgcgttctaacgatgcagtcgatgtcagtgcaattgccaaaatctttggcggcggtgggcatatcaaagctgccggctgtacggtacatggccagccaagagatatcgtaatgaatatcacccatatggtagagcatcagttaaatgaacaagaagaaaagcaggaatcaatttatgataagcggaattcttaatattaaaaaagaaccaggttttacttcccatgatgtagtggcaaagcttcgcggcattgtacatcagaaaaaaatcggacataccggaacccttgatccggatgcgaccggagtacttccagtgtgtcttggaaaggcaaccaagctttgtgacattatcggagattgggataaaacgtatgaagctgttcttttgcttggaagagaaaccgataccgaagatacaagcgggcagacattaaaagaacgagaggtaacggtcacggaagaagagataagagatattatcctttctttccagggaagttacgatcagattccaccgatgtattccgctaaaaaggtaaacggaaagaaactctacgaacttgcaagacagggaatcgttattgaaagaaagccatgtccagtcaccctttcttctatcattattaaaaaaatagatttgccttacgtcacctttgaagtaacatgctcaaaaggaacctatatccgcagcctttgtcgtgatattggagaaaaagcaggatgcggaggctgtatggcaggacttgtccgtaccagagtgtcttcttttaagatagaggatggattcaccctttcagaagtagaagccatgcgcgatgctgatacattactggaacatatcgtaccagtcgatgaagtgtttttgcatctgccagctttttttgtgaaaaaagaaggagaaaaacttctctataatgggaatccgatttctctttctttgtgtgctttggatgaaaattcatcgattagtaactggcaactatatgaggacttgtcatctaatgaacaaatgaaaatggaagaagcggatacagaggatcttggtaagaaagaaaagtcaggcaaagacggaaaacagtatagcagttatactgttggtaacagattccgtgtttatgacaatcagaaaaactttataggaatttatcagcttcaggaaaagaagatgttaaaaccttataagttgtttttgtaggtcactataagaatgatataaaatacaaaatccataccgcaagttagcggtttcggaggaaaaaaatggaatatataacaagctcagactttcatttcaaagacaccgcagttgcacttggaaagtttgaagggattcaccggggacaccagcttctaatggacgaagtaaaaaaacaggagcttcacggactgcgaagcgttgtatttacctttgaccgtccaaccagactgacccttactggtgatacagaatataaacaaatctatacaaaaaaagaacgccgggaaattcttgaaaaacgaggaatcgacatattgattgagcatcctttcacaaaagaatttgctgcattaacccctgacagatttatcagggaagtcctcgtagaaaaagtgggggcaaaagtaattgttgtcggaacagacttccatttcggtaagaaccgctccggtagtattacagacttagaaaagctagaagaagaatgcggatatcaccttattgtagtcgaaaagttacaattaaatggaaaggatattagcagtaccagaattcgtgcttctcttgaaaaaggagcaatggaagaagccaaagctctcttaggcagaaactacagtgtttctggggaaatccttcacggaaatgcacttggacgaaccatacaggtgccaaccattaaccagcaagttccgtcctttaaactactgccgccaaatggtgtgtatgtttctaaaatccactggaaagacgaagtttactacggcattaccaacatcggaaccaagccaactgtcaacaataccagcgaaaaaacagtcgagaccaatatctttgatttcaataaagatgtttatggcgaagaaatggtcgtagaacttctgcattatcacagaaaagaaactcgtttttcttctgtagaggcattgcaggcacagctttttcaggatattgaatttggaaagcagtatgttactaatgtgctgtctcattgatatatgtgatttgaaggactattgtaacaaattattctttaagatcaattattaaaaaacaaaaagatcaaagataagtttctatatccgcttagggatgagtaaagacatatctttggtcttttttgtccacttccagcaagaagagttctatctagaacatttttcaaatacgctctaaggtagaaaaatgaatggtgtccgttactgattttttattcgcctcttttaaatcccattttggctaaggtaggggatgaattgtgtctgttgtccattggatttgacagcttataatccataaaataaataaatttcacaataaaatcaaaatatttttgtggaaattgtctgaaaactagtgtataataaaactaaatgcaaaagcaaaggcttatgcatatcctgaaaagaatgacaaaaggagtggtcttatgaacacaataatcacaatcggaagacagtacggaagcggcggaaaagaaatcggtaagaagcttgctgaatattataacataccattttatgataaagaacttttaaaagtggcagccaaagaaagcggtatctgcgaggagatgtttgaaaacttcgatgagaaaccaaccacaagttttctctactccctcgtaatggatccatacgcattaggctataatgcagcctcctttgatatgcctctcaaccagaaggtattccttgcctcctttgatgccatcaaaaaggtagcagatgaaggtccatgtattatcgtaggccgctgtgcagactatgcattaaaagactatgacaataagctgaatgtattcatccacgcaccaatggctttcaaaaagtcccgtatccaggaacagtatgaggttccagaagccaaagtcaaagacgtagctatcaagacagataagcagcgtgcaagctactataattactacacttctaagaagtggggagacttgaagagttatgatctttgcattgatagtagtatcttaggtattgatggaacggtggaactgattaaacaggctgtagcattaaaagagaagaatttataaagagacgaaataagtcacgttagtttatcgtaagctgacgaaaatggtatgctccctttcagataaacagttttatttttttcaactgtctacctaaaagggagcataccattttattccctgagggcgtctcttctgcttgaggcagcccagaatctaatcctcctcctgatatgctttattcaccttattataagagataaaataaggagcaaaattcttctcttctgcttcctctttcaccggtgcacattcccgaataaaatttgtccgagtcttcggttccgccgccggagtcaaaattccatgcgcctttcctgcatcaatagatttaagcatccacgccatatttcgtcccagagtacgcatgaccataagcccttctaaatcctgctccacctcttcaggagtattgccatgaaccatattccaataagcagaaggaacaagtggcatattgttcatcataaaatatttattcagctgttctaaagcggcagtagaaccggcacgacggcagcttacgatagcagctcccggtttgtaggcaaacccaccggtagagtaaaacatacggtcaaggaaagaagtgattccaccgcttgctccggcgtaatgtacaggggagccaacgattagtccatcacattctttcatttttttgatgactacgttaacagcatcttcaccaaagatacatcttccaagcttgttcttacggcacataccacagcccatgcagcctcggatcgctttagtgccgatatggaaaatttctgtttcaatgccttcctgctgaagtgtcttttctacttcagagagtgcgcggaaagtacatccatttggatgtggacttccatttaaaagtaatactttcataaataatcccaaccctttctatgaattttgttgcatatctgtaaagccattataaaataatagctatattctattcttcctttggttttaaacaggatgtcggtgtataactttccttcacataatctgttccacagacttcatgaactttcgtgatagaaattggtgtgataccgcacacacgaagcagttcacaaccgacttccttacccgcttccaatgccttctgaacagcagaaacatcgccggaaataccagcagaaaattcattcatcatcgtaagattatgggatggggagccataccagacgatatctacaggtgcggctttcatgcactggtcaacggcaacaatgccgattcctgctggggcagcaccgataacgccaaatgccttgccaagtggtgtaccaaatatctgatgtaaaatctctccggcacgtggagtgacgtgagattccatatgccccacttcgttcacatagatgcaggcagcccagtaatcaatctgctctaacgcaatctcaacaagccttctggcatcggaaatgttctctgcaccgaggacgaagaggcatccctgtccacactgcttaccagcatcaattgccatctcaaaacggagcagctttgcatttactgcttttactgcgtcatcaatcgcaatcgcctgtgcgacagttccggttcgggaagatacaatactgatggcctgatattcatcgggaatctcaagaagttccttgatatcttcatgaatcgttccaataacaagaccgatagtatttgccgcagcggtaccgacgaactgggtcgcttctgactgcaaaaaattattcacatccattgttatcctcctcctaaatctctaaatagtatagcatgggttagaaaaaatgtatatataatgccagaaaatcaccttgtttttgtaaaaatatacaggtatactaaataataaggttttgaatacgggggatttttatttgttttgaaacttgtataacttctgagtgaaaaatattgcagttttggaggatgggttatgattatggaagtaaagaagttcaaaaaagtgcttgtcgcaaacagaggagagattgcgattcgtgtatttcgggcattgagtgagttagggattggctcagtagctgtttattctaaagaggacaggtatgcactttttcgtacaaaagcagatgaggcatatccgttaaatccagataaagggccagtggatgcatatttagacattcctacaattatccggattgcgaaggagaaaaaggtggatgcgattcatcccggatacggatttttatcggagaatccggagtttgccgaagcctgccggaaaaatgatattgtatttatcggaccgaatgtagaggcaatgaacattatgggggataagatttctgcaaaaagagcggcagaggagagtaaggttccaattattgacggcagtgattttattattcatgatgtggatacggcaatgaaaatcgcggatgagattggctatcctgttatgttaaaggcgagtaatggcggtggtggcagaggaatgcgcattgtacaaagtcaggaggagatggaagaagcatttgaaaagtcacggaatgaatccaaacgagtttttggagaggcgaagctttttatagaaaagtatctcattcatccaaagcatatcgaagtgcagattcttggcgataattatggaaatatcgtccatctttatgacagagactgttccttgcagcgaagaaaccagaaggtcattgagtttgcaccagcatggtcgatttcggaagagacgagaaagaagattttggattcggcaaaaagacttgccagaagagtcggatatacgaatgctggaacgatggaatttttggtagatgaggaggagcatccatattttattgaaatgaatccacgtattcaggtagaacataccgtgacagaaatggtgacgggaattgatattgtgatctgtcagattttaattgcagaagggtatccgttaaattccccaacgattcacatttattcacaaaatgaaatcaaatgtactggctacgccctgcaggcaagagtaacaacagaagacccggcaaatcatttcctgccagatacgggaaagattgatttatatcgttctggttcgggtggtggaatccgtctggatggaggaacggcttatacgggagctgtcattacaccacactatgacagcttacttgtaaaagtcatttcccatgaccgtacttttgagaatgcgattcacaagtctgtgcgtgcattaaaagaactgaggattcacggagtaaagaccaatattacatttttgattaacgtattaaatcatgaaacatttcataaaggaaagtgctttactacttttatagaagagacaccggaactgtttgaactgcattacaagttagaccgaacaacaaaaatattggaatttcttgccaataagatggtgaatgtcaatccaggaccaaagccgtttcttgagaatagaaaggttcctgttattgatacggaacggaaactgtttggaacaagagatgaatttttaagacttggggcaaaggaatttacccaaaaggtgtatcgaagtgacaaactttatgtcaccgatacgacaatgcgtgacggacagcagtctcttcttgcaacaagaatgcgtacaaaagaagtggcaggagcggcaagagcaacgaacctgtatttaaaggatgcttattctatcgaagcgtggggcggtgcaacttacgatacagaataccgtttcttaaaggaatccccatggaaacgactggatattttaagagaacgtatgccaaatgtgatgattcagatgctgcttcgtgcttccaatgttgtcggctacagcacctatccggacaatgttatcaaaaagtttatcaaggtatccagtgaccacggcgtagatatttaccgtatttttgacagcatgaactggatagaaaatatgaaacttccggtagaagaagcgttaaagactggcaaggtagtcgagggggctatctgttatacgggagatattttaaatccaaaagaaacaaaatacacaattgattattactgtaaaaaggcaagacagttagagagaatgggctgtcacgttattgcgttaaaagatatgtcttccctgctaaaaccgtatgcagcaaaagaattaattaccgcattaaaggaagaagtccgtgtgccgattcatttacacacacacgatacaacgggaaatggaatcgcaacctatctgatggcagcagaagccggagctgatattgtagactgtgcgattggttcaatgagttcccttacgagccagccgtccatgaatgcgttggtggaggcattaaggggaacgaagcgggataccggaattgacccggatggtctccttgttttaaatgaatattatgagcatgaacgaaaggtttacaagccatttgagagtgatatggactctccaaatccggaaatttataaatacgagattccgggaggtcagtattctaactttgctgcacaggtcaaagaaatgggtgcaggtaatgattttaatgatattaagcgtctttataaagaagcagatgaggtgcttggcaacatcattaaagtaaccccgacttcaaaagttgtaggagatatggcaatttttatgttgaaaaatgatctgacaaaagataatattttagagaaaggaaaagacttgtcttatccagattctattgtacaatattttaagggtgcattaggacagccagaaggtggttttccggaaaaattacagcgtattgtattaaaaggacaggaaccgataacggtgcgtccgggaagtttacttcccgatgtagattttgaggcaatcggcaggcatcttcgcgaaaactattacatggaatcgatggaacagccggaagtcatggagcagaaagtgctaagttatgccctttatccgaaggtatatgaggactattgtgagcatttccaggcatataatgatgtatcgaagttagaaagtcatgtgtatttctatgggcttcgtccaggtgaagagacaactatccagattgaggaaggcaatgatacattaattaagtttgtcggtaagtcagaacccgatgagaaaggataccgcattttacagtttgaagtaaatggattccttcgggaggtaaagattcttgacaagcattttgaagtgaaggcggaccgcagattaaagacagatccgaaaaatcctggtcatcttggagcaactttaccgggaacaatctgtgatatccgaatcaaagaaggtgaccgtgtaacgaaaaatatgccactcatggttattgaggcgatgaagatggagacaactgtcatttccaaagtaaatggtaccgttgataaaatctatgtcaaagatggagaagaagttaacgaagatacgcttcttgtatcgtttattatcgatatggaagaacagccagaagaagtccatccggaactgccagaaatggactttacaaccttagaaaagaacgaattcaaaacggtcgatgtgaccgaagaagaaaataaatgaaatttggaggtgttgatggaacgagaacatattactccgcagggagtatctgtatttcacgacaaaaatgaaaatattcatagcttctgcctgtgcctttatgtgcgggcaggttcgctgtttgagacaaaggagaataacggaatttctcattttttcgagcatattgtatttaaaaacattcattatcagatgggagagaatctgtaccagactttagaccggtgcgggcttgattttaatgcttccacttatgaagaatttattcagtttattatcacgggagcaccggcacattttgaggaggcagcggagattctgaccgggatttttgaaccgattactcttccggaagaagtgattgatacagaaagaaagcgcatcaaggcagaaatccgtgaggaagatgaggaaagcagccttggttattttacaaaaaagattgcgtggaaaaatacttcattagagcggacaattaccggaaagaaaaaaacattagataaaataaaagggaaacagcttcgtaaatttcaaaaagaagtactttcttccaataacattttcttttatataagcggcaattatccagaaacagcagttgtaactgtaacaaagcttatggaaaattacccacttactgtaatgaaaaaagaacggaagaatctcgctccggttccgaaacgcttttttgcaagaaagccaaaagtgtatgtgaaaaacagtaagaaaacgtgtgtctgcttttcagtagacattaatgcgtcaaattatacattagcagagaaaaatctgctgtttgatattttatttgagggtgagttctgtaagattcatcaggaactttcagagaaaaagggctatgtatatagctatgacccatgtttccagcattataataatatcgggcagatgacactcacttatgaagtgttgccaaagcatctttatgattctgtggagacggttgtagaagtgttgaagtccatgaaagagggcataacagatgaactttcctatgttcttcctcattatgtagataatgcggggttccttttagatgatacggaggaatttaactgggtgagagcttatgaaggacatattcttgacgtatactataaagacattgaggagcgaacggaatcttatcgccgggttacaacagagcggatgacagagatttgcagggaagtattcaggcagagtaatatcttgctgacagtaaagggtaagaaaaaaaaggtggatactgagcggctcgcagaaattctttgtgatgcgctgtcttgcagatgaacgagtttttagacacgcaccggattgacccggaacgcttcttgggatataataaaatcgtttatggaggtgtaatgttatgagagaaaattcatggcttagttatacagaagaggacgataagaatgtagaagttctcgcgcaagagtataaagaatttttaagtaaatgtaagacagaacgtgagtgtacgcagtattttatcaaagaagcggaaagtcacggctatcaggatcttaataaactgattgcacagggaacccgcttaaaagcaggagataaagtatatggtgtcggcatgggtaagacaattgctcttttccagattggaaagcagccgcttaccgaaggaatgaatatcctgtgcgcccacattgattctccacgtcttgacttaaagcagaatccattatatgaagataccgaattatcttttatggatacgcattattatggtggaattaagaagtatcagtgggttgcacttccgcttgcacttcatggtgttgtggcaaagaaggatggaacggtagtgaatgtaaatattggtgaagatcctgctgacccagttgtttatgtaacagatttgttgattcatttagctggaaagcagatggaaaagaaaggctccgttgttgtggaaggtgaaaatctggatatccttgtcggaagccgtcctcttgcaggagaagaaaaagatgcagtgaaagcgaatattttacgtcttttgaaagagaaataccagatggaagaggaagacttcctctccgcagaaatcgaagtggtaccagcaggtccagcaagagactgtggacttgaccgcagcatgatcgccggttatgggcatgatgacagagtatgtgcttacccatcttttgcagccatgatggaggcagggcatgtggatagaacttcctgctgtcttttagtagacaaagaagaaatcggaagtgtcggagcaacaggtatgcagtccatgttctttgagaataccgttgcagagattcttgctctgatgggacaggattccaacttagcagtaagaagaacccttgcccgttccagaatgctttcttccgatgtaagtgctgcttacgaccctgcttatgcagaagcttttgagaagaaaaactgtgcgtactttggaaaaggaatggttattaataaatataccggagcaagaggtaagtccggctctaacgatgcgaacgcagaatatcttgcaagacttcgacgtatttttgatgataacaaggttgcgttccagaccgcggaacttggaaaggtagattatggcggaggtggaaccatcgcttatatcgctgccctttacggcatggaagttgtagacagcggcgtggcagtattgagtatgcatgctccgtgggagattatcagcaaatctgatttatatgaggcgaaaaagggatatgttgcattcctgaaaaatgcataacagaatcaaagacaagaataaaatttgtatgccggcacattgaagtttcaggataaatccatttccttcaacttctttcaacgtgctagagcgtgtttgaaaaaccattccagcaatttgcacacctcaatttacggtatattttgccttcattcagttgccgtagcccgctacgccgccctcattcaggcgaaatctcccgcaaattgtgatgcacatcttgcagaaagcatttttcaaacacgctctgggatacaaatataccctaagtaatgtcttaataattataaaatattgaaactggagaaacatatgaattgtcagaacgcacagtccatggtactgaattttattaataataagttagataaagaagagacaaaggcttttatcgagcatgtccgagattgtaaagattgctgggaagaattagaaatctattatgtgatgcttgttggattaaagcagctcgatgaaggagaagaactggctgcggattttaggaagaagcttcagaatgaagtagaaagtcgttatgtagagattgaaagagaagcaaagcgtaaacatatagcgaaaatcataacaattcttgtcacggcggcgattttaatatggatgtttgcgtatctgatttctgcaatgttgctgtgatgttttatccattgcattgtatcattagggaaaagaaataagaatgatacgatacatcagcctgcactgaagaaagaaatgtctgtattcagttgtgggctgttgtattattttgctgaataattataaagaaattgaaaaatatgtttatgttataattgttaaattatgtattttcagaacttttcagcatttgattgtgtgataaaattccgagagtacataaataaagtttaggaggaaagaatggcagataaaattatgctgttggacggacacagcctgttaaaccgggcattttatgggctgccggatttgacgaatgccgagggaaagcatacgaatgcggttcttggctttttaaatatcatgcttcgctatgtcgaagaggagaagccaacgcatcttcttgtggcatttgaccggaaagaaccgaccttccgtcatataaaatataaagaatataaagggacgagaaagccaatgccagcggaattacatgagcaggttccgttgatgaaggaagttttaaagacaatggaaatcccgattatcacgcaggcaggcattgaggcagatgatattttgggaacaatcggaaaagaagccgaggaagctggatttgatgtggctattgtatctggagaccgggatttattacagcttgcgacaaaaaaagtaaaaattaagattccaaagaccaaggcctctggtacggtaacagaggactattatgaggaagatgtccgcgaactttacggcgtgagcccaacagaatttattgatatgaaggggcttatgggcgatacttccgacaatattccaggagttcctggtatcggggaaaagacagccgcaaagattattaaagagtaccattccattgagaatgcccatgagcatatcgaagaaatcaagcctgcccgcgcaaaaaataatctgcaggaatactatgagcaggcaattatgagcaaagatcttgcgacaattaaaaaagactgcgatatttcttatgattttaaagatgcaaagattggaacactttttacaaaggatgcataccagttatttaaagagttggaattaaagagcctttttaaatattttggggaggacgaaaaggaagaagagactttagaagttgtaagtacttttgacctgggcgaaatagagaatgcatttacttctattaaagaagagggacaggcagcgcttggaattatcggtgtgagtggaaattgtaaggggctttctcttacatggagggataatacagtacttgccttagtgggcggctttgtgacagaggactatttaaaagaaaagattacagagcttttaaaagaaggaacagagctgattgtccttgattataaagcactgttacatttttcagaagaagtgcgagagtatgaaagccagattcaggatgtaggtatacaggcatatttgttaaatccattacagtctgcgtatgactatgaggacattgcaagagattaccttcgtcagatgcttccgtcaagaaaggaagtctgcgggaaaaaagcgttagaagaagtcttttcacaggaagaagagaagacagtgcagatggcagcctatctttcctatgtgccattccatgcttatccacttgtacttgaaaagttgagagaagccgaaatggaagaactctatcttacgattgagcgtccaacggttgccacgctttacgatatggaaaagtacggaatcacagtagaaaaggatgccttaaaagaatatggcgaccagcttgtaggacgtattgaagagctggaaaaaaatatttatgagcaggcaggcaagacatttaatatcaattcaccaaaacagcttggtgtcatcttatttgaagatttaaagatgccgtttgcgaaaaagacaaaaacaggctactccacgagtgcggatattttagagaagctggcaccagattatccgattgtttctaacattttagaatatcgtcagcttacaaaattaaagtctacctatgcggatggtctggcagcctttattcaggaggatggaaagattcacagtatttttcatcagaaagtaacggcaacgggaagattatcaagttctgatccaaacttacagaatatcccgattcgtatgccacttggcagggcgattcgaaaagtatttgtgccagattcaggttatgtatttgtcagtgcagattactctcagatcgagcttcgtgtgcttgcacatatggcaggagatgaacacctgattgatgcgtaccgacatggagaagacattcaccgtatgactgcatctcaggtatttggtgtaccatttgaagaagtcactccgctgcttagaagaagtgcaaaggcagtaaactttggtattgtttacggtatcagtgcgtttggtttaagtcaggatttaaagatttcgagaaaagaagcgagcgaatatattgataaatattttgcaacatatccgggaattaagacgtatcttgacggcaatgtagcatttgccaaaaaggaaggctatgttaagacgttatatggccgtgtccgtccaattccagaactttcttcgagtaactttatgcagagaagttttggcgaacgtgtggcgatgaattcttccattcagggaacggctgcggatattattaagatcgcgatgattcgtgtgagtaaacgtctgcaggaagaaaagcttgcttcaagacttattttacagattcacgatgaacttttaatcgagacaaaagaggatgaagtagaagaagtacgcaagatattaaaagaagaaatgatgggagcggcagaccttaaagttccgctgtctattgatattgaagaaggaaagacctggtatgaagcaaaataaagagcaaaataatatgaaagttgtcgggattactggcggagttggttccggaaaaagtgtggtcatgaacattttaaaagaaaaatacggtgcggaagtgattcttgccgatttagtggcacatgatttaatggagccaggccagcagaattatttagacatcgtggaggcatttggtgagggaatccttgcccaagataaaacgattgaccggccggcattggcaaaagttgtttttggaaatcaggaacgactcgcccgtttaaatgcgattacacatccgaatgtaaaaaaagagattttccatcggatcgatgggataaaggaaaaaggagaggcttctttcattgcggtggaggcggctctccttttagaagaaggctatcagaatgattttgatatgatgtggtatgtctatgtagatgaggcaactcgtattgagcgtctaaaagaaggccggggatataccgaagaaaagtgccgtgaaattatggcaaaacagcttccagaagaagtatttcggaaggaatgttccacagtaattgataaccatttaggaatctctgaaacggaaaatcagataaaaacggcagtagagagcctgctttctctttactaactctttactaataagataatttagtatataatggttggtaaatttgagccaaaaggatggtaaatagatgaatttagcgagcatcgccagcggtagcagcggtaattgtatatatgtaggtaatgaaaagtcccattttcttattgatgcgggaatcagcagaaagagaattgtggagggactgacacagatggaagtagcaccggaaaccattcagggaatcttcgtgacacatgaacatatggatcatatcagtggtcttggcgtgtttcttagaaagtatcccgttccggtatttgctacagcaaaaaccattgatgagattttaagtacatcctctcttggaaaggtcgataaaaatctttttgagagtatcacaccggacaatccgatttacatggatggaattaaaatagaagcatcccgtattcttcacgatgcggcagacccggtctgttatacggtaagtgatacggaatcaaaagtcggagtagcaaccgattttggaacatatgatgaatatcttgtagagaagttacagggctgtgagtccttactggttgagtccaatcatgacttaaacatgcttatggttggcccgtatccatatcctctcaagaagcgaattatggggaataaagggcatctttcaaacgagagagccggacagtttttgtcaaaagtaattggagaagagtgtaaacatatttttctggggcatcttagtaaagagaataactatggtgaactggcctatgagacggtaaaggtggagcttttattacataatattgatcttgataaagcgaactttactttgcaggtagcgagcagaaccgcacctacttgtataatctagggaaaaaagaaaaagaacttgagcagttaaatcgtaattatatctagtaattgctttgtataattaccttaaataatttacacacataaggagtattaaccatggaaggaaaaaagcttaagaaatcaattatcactgtactcggaaaagattctgttggaatcattgcaaaggtttgtacttatcttgcaaataacaacgtgaatattcttgacattaaccagacaattaccggcggtttcttcaacatgatgatgattgttgagtcagaagaagtagttaagactttccctgttatggcaagcgagcttgaacagattggagaggaacttggtgttaagattcaggcgcagcaccaggaaatctttgaaatgatgcatcgtatctaggaggcccgctatgttaaacataaatgaagtaattgaaactaataagatgattcatgagatgaaccttgatgttcgtactattacaatgggtatcagcctgttagactgcgtcagtgattctcttgatgaagtatgtgagaatatttacaacaagattacaacaaaagcaaagaatcttgtaaaagtaggaaaggaaatcgagcaggagtttggtatccctatcgtaaataagcgtatttctatcacaccgattgctttagtaggtggtgcctgctgcaaagggccagaagactttgtacgcattgcaaaagagttagaccgctgtgcaaaagaagtaggcgtgaattttatcggtggatattctgcattagttaacaaaggaatgacaaaagcagacaagtatcttatcgagtctattccagaagcactttctgtaaccgacagagtgtgcagttctatcaatgtaggttctacaaagacaggaatcaacatggatgcagtaaagatgctcggtgagattattcttgagacttccagaaaaacagcagataaagacagtatcggtaatgctaagcttgttgtattcactaacgcaccagacgataatccatttatggcaggtgcattccacggtgtgacagaagcagatactatcatcaatgtcggagtcagcggtcctggtgttgtaaaacgtgctcttgaaaatgttcgtggtaaagacttcgaagaactttgtgagacaattaagaagacagctttcaaggttacccgtgtaggacagcttgtagcaaaagaagcttctaagcgtcttggcgtaccttttggtattattgacttatctcttgcgccaacacctgcagttggcgacagtgttggagaaatcttagaagaaattggtcttgaatatgccggagcaccaggaacaacagcagcactcgctctcttaaatgaccaggtaaagaagggtggcgtaatggcttcctcttacgttggtggtttaagtggtgcatttattccagttagtgaagatcagcgaatgatcgatgcagtagaggcaggagcacttactttagagaagttagaagcaatgacttgtgtatgttctgttggacttgatatgattgctatcccgggagatacaaaggcaacaacgatttccggaattatcgcagacgagatggcactcggtatggtaaatcagaagacaacagcagtccgcattattcctgtaatcggtaaaggcgttggtgatacggtacagtttggaggacttttaggttatgctccaattatgccagtgaatcagtttgactgttccgcattcgtaaacagaggcggaagaatccctgcaccaatccatagttttaaaaattaaataggaattgccgcaggcaaggagacgctcccccagagagaaggtatcttctctctgggggagctgttttttgttaaacgggaattattaactggtcactgcacatgaacgaagtgacaccgcatatccatgagcgtcatgcattcgatgccataaccgacaggaaatgtagctggacgaagtgacttgactgagtaaattgaaatggaaatatgacggagagtgtgatatgatttgaatggaaaaatatcacttcaagacggtagacataatgatgataattttgttggtaattgtgttgagaaagtgaatacagaacttaaaaatctatctgaaagcagagaaatagaaaaaatgtggaatcaattttagagtaaaaattgtttcgtggaaaatatccaatactgtgatgttataaaaacaatatctactctgatattaaatatatatagttaataaagagaggtgcatatgctatgccaggtatactcgtggttgaagatgatgaaaatttaaatcgtggaattacattctcactgaaaaaatccggatatgaggttttttcagcagaatcagtgaaaaaagcgaaaagaattgcaagtgataataatgtggatgttaccatttgtgatgtgaatcttccggatgggaatggactggaatttgtaaggtggatgagatgcaattataatacatacattatttgtcttacagcactagatcaggagatggatcaggtcatgggatatgaagcaggggcagatgattatattacaaagccgtttagtctttcggtacttcttttgaaaatagaagcacatttccgccgcagacaggagaaaacggaagccggaaagatgatttcgggagatatcatatttatcgcaggagaaatgaaagtcctgataaagagtcgtgaaatcagtctgacaaaaacggagttgaaaatgctgactttttttcttcagaatccgaaacagattctttcaaaaacacaaatattggaaaatgtgtttgatctggaaggggattttgtggatgaaaatacaatcgctgtcaatatcagaagactccgtgagaaaatcgaagacaatccggctgcaccggtctatataaagaatatcagaggtcttgggtatatatggaatcaggaggtaaggcagtgacaaagagatatcgcaagaagatcacagtagtgctctccttggtattgcctgttatagtattgtttgcaatattaaattgctttaccacgtatatgttttatgaagattataaatataaaatgaatcttatgacagagattgctgcaaaggaagaattttccgggctggatgctgtttcggaattacttaaggataaggatattgaaactaacgaacagggaaggcgattattggagcaatatggatactggggaataaagggaatgcattttattcgcaatttcggcatcaggttatggtgaccggtgctgtaagcactgtgatatgcgtgcttcttttgacttttttactttattggaagaaaaaagaagatgcgtgtcatcagaaaattttagaccaattggaagaaattctgatcagattccgagaaaataaatttgatgatttactgaaaacggaaaatcatgcagaactggaaaaattgaatgaccagcttgaagcaatcggacatcatattcagttgataaaggaagaagcaagggcagaaaaggagaacacgaaagaaatggtttctgatatttctcaccagttaaagacaccggttgcagctttggatacatgttttagtgtgctgatgcagaatgacttaagtgccacagaacaggaggagtttcgtatccgttgtcggagtgctctggatggactggagacattattgcagtcgcttcttgaaatatccaagatggaaactggactgattcagattaataagaaaaaacttccacttatggatactgtcatatctgctgtgaaccgcacttatcctaaagcggatgagaaagaaatggaattcgtttttgactatgaaaaagagctggaaacatgcacgattatgcaggataaaaggtggcttggtgaagctgtgatcaacgttctggataatgcggtcaagtacagtccgtgtggttcaaaaatatttatccggttacaaaaaagaaacgatcttgtaagaatggaaattgaggatcagggaattggtattccgcagaatgagtatcacaaaatttttcaacgattttacagaggaagttccaaggaggtcatggaaaagagcggtacaggaatcggactttttctatcgagagaaattatcgaaaaacacgcaggtacgattacggtaacctccggcaaaaagaaaaaaggaagcacgtttgtgattcaattaccatatgttggttaaattttaagtgggcagaaatcttacaattctgtaagacttctgctcgttttttgaaagtgaaatgaaagattgccctgatacaatttggatgtaggatgaaaaggaggcaacacatgagtgtgatattagaaaccaagcagctttgtaagttttatggagcaggtgagaatcaggtcaaagcggtcgatcaggtggacattcagattgagcagggagaatttgtcgcaattgttggaaagtcaggttccggtaaaagtacattacttcatatgcttggagggctagacaccccgacaaaaggcagtgttactttagcagggaaagatttatacaggatgaaggaagatgcccttgctgttttccgcagaagaaaaatcggatttgtttttcaggcatttaatctggtttcatctgttaatgtctgggaaaatattgtactgccactggggctggatggaagaaaagtggatgaagcgtatgtaaatgatattattgcaactctggggattgaaaaccggatttataatctgccaaatcagttatccggaggacagcagcagagagtagcaattgcaagagcactggtgaatcgtccggaaattatatttgcagatgagccgacaggaaatcttgattctaagaccagtgatgaggtaatcgctctgcttaagatgacagcaaaaaaatatggacagacaattgtaatgattacccatgatgacgaaattgcacaggtcgctgaccgtattctggtgattgaggacggacaggtggtggatttcagatgaagacaataagcaggattgcatatagcaatgacaaaaggaacaggacaagaagtatactgatcatgatggcaatctgtctgaccacgatgctgcttgttatcatcagtactgtgggaaatggggtaattcatttacagaaaagtcaggcggcaggatcatatggaagcaattatggtctgtttatttccgcagacggatcgcagttaaaagaagtaaaccgccgtgcggaaatagatgctacaggcactatgtgcaccgaaggtatcataaaaggcaatgaaaaaggcgggtttgtctgcatggatgagactgcaagaaaaatgcttccttataataaagaatatgagttgaaggaaggacagtatccggaaaaaatgcaggaaattgccgcaggaagagcattttttcgtgcaatggggtatggtgatgtaaagatcggagatacggttacactggattaccgcgcagggatgcagtcagaatataagccggaagaatttgttgtcagcggaatcctatatgatcgggatgagtataccatcgaggcatcttatgttgctttcgggtcacaggagttttatgatgagcacgtcgcagagaatgacagacagtataatatttattttactttaaatgattctgcaaatgtatctatgaataatattgattcggttataaagcagattgcagcagcttgtgggatcgaagaaaaaaacgttatagtcaatgatctctatttgcaatgggtcttgcagccaagttatgaaacgattgcggtatgcggaattctgattcttgcaattgtacttttctctgttgtggtcatttataatatttttcaggtcggtattgtcaacaagatacaggagtatggaaaaatcaaggctctgggagcgacaaaaaagcagatgaaacaactaatcttcagagagggtatttttttgacaatttcttcaataccagttggattgcttcttggttttctgattgcaaaatacggttttaactggctggtagaacaggggaactttgtatcaaccggaactggctctatgggagtccaaaatcagcaggtgccactgttttccctgcctattatgcttctatgtattttcgtatcatttcttaccgttgctttggcactgcgtaaaccaatgaaaattgtttcacggatttcacctatcgaagcaacacggtatttagaaaatgcagaaacacaaaaaaaaggaaaacgaaatagcagaaaaaatgtcaccatgttttctatggcaatggcaaatataacgggtaatccaaaaagaaccattggtaccatccttacactggggctttcctgcgcattgtttgtgattatctctaattatgtaggaaatattgatacggagcatgaagcacgtctttccgttaatcatggacaatttgaactgcagcttgactattctgctgagtatgatgaaagatatccggagaataatctggatacgattctgacggataatccattgaatgattcgctgattgaagaaatcaaaagcattccgggagtgacagatgttatgacgagagagattgtctctgtaaatctgaacggaacaagatttccggctgctgttgtgagtaaaaaggattttgattttatgcgccaagatggggatattggttctatggactatgatcaggcggtaaagaatggtgatattttctttggctggtcggcgtggatggaacaagatggatatgctccgggtgaatctattgtatttgactttgagaatggaagtggaacctatacctatcagggaaagattgcaggatcttttgtaagtgcggacacttatcttgtcattccagaaggtgtataccgttccatgaatccgagaggaacagcctatggctatctgtgggtggactgtgataaaaaagatgtggcatctgtggaacagagtctgaatactttgatttctaatacttcgcatataaaaatggatacctatcatgcacagttagaatctgcagaatcagtaacccgcatgatgaagcttggctgttatctgtttatggcggttgtgggactcatcggttttatgaatatggcaaacaccatgatcatgaatattacgacaaaaaagcaggaatatggtgtattacaggctgtgggcatgacaaataaacaattaaatttatgcctgcagttacagggactgatttttacggttggcaccatatgcgtagctttgattattggtctgccgctcggctatgcacttttttcctatgcaaagaataatggaatatttggaatgaatgtctatcatgttccaattacaccaattcttgctatgattttgctggtcggtcttttgcagattgtactttcctgcgttttaagcagtaatctgaaaaaggaaacgctggttgaaagaataaggtatcagggatagcaagtaaccaagatataatcttgcatattctttttctgtttacccgaccacagaggatgttcagacatacgaagagactattatgttggaagaatagagttacgaacctccagttcgtagaattcaaaatttaacatgaaatgtgagatagagcgtatggaaataaactatacgttctatttatttgcctttttgaaaagagtgattaaaaaactattgacattttgttactggagtcaacaaattaatattttcagaatgaaattggagtctccttcataatatttgtagagacgaagatggaaggtgaaaagtatatgcattatcaaaattacacttaccggacaggaagttatcgaaaacaacataaaagatatactgcgaatcgaaaaagacaggaggaatatgaatctctcccgtcttttttgttttttcggttgcgtttgcttatttgtattatgttgtttttggcatttgttactgcagataaatatgttttgacaaaagaggatacagcaccagtgtttcagaagatagagaagaatcagtcctataaggatctaataaaaaaatacaagttaattggtgaatagaagattcttatatacaaagaaagagcactcatgataagatattttcaaaatacaagggagattacatacatgttgatatatttaatggcattagataccgaggaggagaggataaagtttgttaggctttatgaggattacagaaatcggatgcattatactgccagtattcttttaaaaagtgagatagaggcggaagatatagttcatgatacttttcttacgctgacagattatctggaccggatcgatgaaaaagattcagttggaacatggaattatattgttactatcttaaaaaataagtgctataactttttgaaacgcaataagagaatagaattgacggaagacgaagaagtttttgaacagcctgttgaaatgtataatttattagaaaaccagttaataaaagaagaggcggaagaatttttaaatactctgattaagggattaaaatatccttaccgggaagttatttatcttcaatatcataataagttaaatagccgccagattgcagaacttcttaggaccagtcctgcgaatgtaagaaaaatttcaagtcgggcgagagaacagctgaaaaaagggatgcaaaagaaaggatatacttgtgaatatggattttgaaaaattattggagcaagaagcgaggaaggctgccagacaggattatgaagaggtaacagaaaaaacaaaagattattcttacaaatattccaaagcgtttatccagaaaatgaatgcgatgattcatgaggaaaaaagaaaggcaaaaaagaaaagacgatggcatattttgctggtggcagcgattattttaatattgaatgcaggaattgttttagcaaacgatgatttgagagaaaaagtgggggagcttatcattcagtttttcgacgataatatccatatacgcagttctaaagagattgcagattcagaagaaatatttcggcaactgcatcttggctatgtaccgaaagggtatcatatactatatgagacagagaatcctacgactatgtatgatgtttattatgaaggcacaaatgataattatattacttttatgcaaggttttaaagaaaatgtagatgtacatattacttatgatggaactggaagaaaaaaggttcaggtaaatggtaaagagctgtatatgattaaagatgggaatataacttcttattattacgaggatggagaatatcttattactttgtctggtacagaaaaagagtcagaattaataaaaatgctaaaaagtttgaaataaagtgtcacactttccttactttaattgtgtcttatatagagaaaagaaattttgcaggaaaagcaagggatatggtaattgaaataagatacatactgctataaaagataccaggtatttaatgaaaatgtatataaataaaaattaaagtaaggaacaaatgaaatttgaaataatatattccagaaaaatacgagatgcagtagctgtttttacaatatttatgtttatatgtcagtatggcttgaccagagaagatgtggcggagaatttttcaagaactgcaccaacctggggatggtttgccttggataagccagactgggagttttggaatgaggaattaaaagagacacgagtatggaatgaagaagatttccgaacttataaaaggaaagtttttaaaaaagatattatacaatctgtctattttttacctgtgctatgggtattaaaatttgtagataattattacattcctgtcatattgatgggaataacagtgttcatttattgcagctcatatgcggataaatgggcaagtagaataaaggatttgacaaaagaatatcagagagcggcattacgtcaattgatagatgagaaacagaaagtttatatcaaaacggaaagtattgaggggtaaaaatgcttaagaaaatcattaagaaaagagcgtatgagggtaataaaatagaagataacttattatttgttaccttgcagacacaaattgtaggattagatatgaataatggatatgaacagatatttttatcagataaattatcgaatatgtgtaatttttattatgataaagacacgaaacaattgcttgtctataatacatcgggacatgcctatttatatcagatgccggaaggaaagcgtttgtcacaaaaactttatttgcgagcaatggatttgcaaccagatagtattgcacataaaggagattattattggtattcagacacaaatttttgtctacgccgtcttgatataaaagatggaagcacaaagcagatattaaaagataaggaacgaagagttgtaaatgtgatacaggtagcagataggttatatatttttacagatatgagaagggaaatagaaggctatgtaaaaatactctgctatcatattgatgaaaatggagatttaaaatacgaatttgaatggggagaaagaccgtatgtttttatggggtatgtaagaagagattttgatagaaaaacagtaatagtaggagcaaagacatacacaaaatatgtaggcgattattatgtagcttttgaaccggaaaataaacgatttgtgccaatatatcctattacagatgaggcatgggaactgtatggacatacaatgctagagggaaataaaatccttgctgctaatcccaaatatgtgaaagtaatagatattccatcaagaaaagttttggcaaaatatgaaccagaagagacgatatatagtgcgactttcctaaccaaaaataagggagctatttttacgaataggggagtatatgaatttacattttaaagagaggcgaattcatgaccgacgaagaaaagctgacattaatacaaaaatatgaagagttatcagaggaagaatttaaagaggagtgttttgaagatttaaaaaagttcgcctttgataaagatgatacagtcaaaacttttactgccagtgtactttcacgttttgtaaatacagcaaaacagaaggaagccatcgagattttattgcaattatgtcatgaagaaaatgagctggtaagaacagaagcttatgatgctataggttgctattgtgaaaaaagcgtggtaaaaagtcttgaaaaagctgttttatcggaaaaagatgggttggcaagaagttatgcaattgattcgtggatttatgtacaacagcatttgtgtacaaacgagacagaagttattggatatttgaatgctatattagaaaaggaacgagatgataattgtatcttgaattgtctgtatggcaaatattctttcggagagagagctgttttggatgaaatccttaattatatcaagaatacagattatcatatacggtgtagtgttttgtctataattgaattaattttggaggaggagagctgcacaaaagaatgtaaaagaaaaataaaaattacacttacagaacttttaaaaagggaaaaagcaaatgcagtgaaagagcaggcagaagaaataatgaggtggctataatgtggcatatatggaccatagatgactgggagaaaaatattgatttgaccagagaagggcatcgaacaggactccgattacgatttgataaagatattgacagcgaagttcgcagagcatgcaaagaatttgccgtctttttgcgaagagaatatttttttcagtggattaatgcattaaaactgacaccgattggacaagagaggcaggcaacaaattatgcacgatatatactagatgaatatgcggaaacgagagaacatccatagggggaagaagattcggatagctgccctaaaattatcatagaatcatttataaaagatatatcaggacatattgtgttaaacgcatcatgtcagttacaatcaattgaagaaaatgcgaaatgtaattataattgcaagttcccgataaaaacggaagtgggtttgctttataattttgctaagcagctaccgaagcttaatgaacaagaagtaggaatatttgttgaacttttatgaaaatctatatcatgtaagaatactgtaaaaaaactgtcattagtctatcatacattgaacacatttctccaataaaatgataaaagatacgaggaggaatgttgttacaatgaacgaaaaagaatattataatttaattaaaccttatgaagatgctatgcagatgattttgagccgtctagatacattaaatcatactttatatgaatcatcagctacgcatcttgttccaattcataatatccagagtaggattaaatcgaaaaaaagcattgaagataaattgataaaaaaagaaaagaaaccgtcactgactaatgctaaaaattttcttatggatattgcaggtgcaagagttatttgctattttgtcaatgatatatataatcttgttgagattttaaaaagtcaaacagacttaattgttatgaaggaacgtgattatattgcaggacctaaacctaatggatatcgaagttatcatattatattaggtattccggtttattgtcttgatggtatggaatatttccctgtagagattcaatttcgaacgatgtccatggatttttgggcgagtatggaacatcgtatcaattataaaaaggaacgacaggatagagaaaaattagtaaaggaattgaaggagcatgcacgcaaactggaaaaaatagaaaaaagctttgaaaaatatagtgagaatattcaaaatactgttgagtagtatttattttataaaagatagaacatagtatgcattatcagatgtggatttggagcaaatttgaaaatgtgatagcacattttcttatagcgatgatggaagaactgataatattatactatgttcttttttatatgtttttgttgatgtactatcattacaataatataatatcttataaggaggtggcatacatgggaaaaattaaattattacatggctcggatcatatcattgaaaagccggatcttttacttggtaaaacaaataatgattatggacggggtttttattgtacgcaggaattatctatggctatggaatgggcttgcaagaaaaacagtgatggttttgtaaataaatatgttcttgagcaagattccttaaatatattgaatttgttagatggaaagtacaatattttacactggatggcattgttgctaaaaaacaggacatttcgtctttctaatgagatcgcaatagatgcctgtgattatattattgagaatttttctattgatttaaaagcctatgatgttattattggctatcgggcggatgattcctatttttcttttgcagaatcttttgtgcaaaatggtttgcctcttcgcagtttaaacgaagctcttcatctgggtagattaggaacgcagacggtgttaatttctgaaaaatcttttcgtaatctgacatttgacggggctgattttgcagacaaaacagtttattatcctaagtttattgcaagggattctaatgtgagagaaacgtatcgaagagaaattcgtaacaggcattcctataaaaatgatatttttgttttggatattctcagagaggagatgaaggacaatgattcacgcatacagcgaatcttatctatatgatgcgaagcaaaatctggctgaatgttttgattatgcgattagcaattgtcgttttaatgcagatatattttcaaggctgtttgtccaatctggatatgcagacaaatttgagcgtggaaatccagcgattgtttcaggaatatctgggatagaactggctcaggaaatcattatgtacgcttatatgaattacaaatttccagaaaaaatattttctgaggaacgttctgaagtctattgggctggttgggctttggcagagtatcagtgggctacctgtagacgattcaaagatattttttcaagaatacctctttcagaaattgttacaatgtatagcgtatatcatgaaatggatatagggcatttcattgaagatatgaataaaaaatatatgagcataacacaggaaattcatttagaaacaattcgtgaaaatcgtggcatatctcaagtagaacttgcagcactttcaggtgtaaaacttcgttcgatacaaatgtatgagcaaaaagtaaatgatattgataaagcacaggcgagaaccctttacaagctttcaagagtactaggatgcagcatcgaagatttgttagaaaatccggaactgtaaaaagttaatgctcgacttaaattttggcagtaccataaatatatagcgtcagaaaggaaaatcatgaaccagaaaaacatagtaaaagatatacagtcaaaactttttgatcttcaggatataaagtatcgggattttcatgcgaagcttatgccgacggtgaataaggagaagattatcggcgttcggattcctgtactgcgttcatttgcaaaagagtttggtaaaactaaagaggcaaggctgtttttgcaagtgcttccacattcgtattatgaagaaaataatctgcatggtcttttactagagcagataaaggattacgaaaagtgtttacaggagctggaacgatttctgccttttatagataattgggcaacttgtgatttgcttgctgtccgtacggtaaaaaagcatcttgatgtatttatagaagaggtgtatcgctggatacaatcacagcatacatatacgatacgatttggaattggtatgttgatgcgatattatctggatgaaaattttcagatggagtatccggaaaaggtgatgcagatttgttcgaaagagtattatgtgaatatgatgcgggcatggtattttgctacggcacttgcaaaacaatatgagaacattcttccatttatagaggataaaaagctggatgtctggacacataataaaacaattcaaaaagcgattgagagttatcggataacaccggagcagaaaatgtatcttagaacattaaaaataaagtaatgattccattcgaggtgacaaagtgaaatcactatcaatttatacacttacaagaaatcagagtatagagcatatatcaaaactggaaaggcagttatctggaaggaagtttcctttaaaaatacgtacctgggaatgggggagtatgagggcattggcagctcagttggaaatgcatatgcaggaagtatattccctccgttttttctattctttccagattccaagattgggaaaagagtttgatcttcttcagattaaggacaatcatattgtaaatattgaattaaagagtggggtggtttcggatcaggcaattcgtaagcagctgattcagaatcgctattatttatctgttttaggaagaccaattcaatcttatacctatattagcagccagaacaggctggttcgtctgacacatcatgatcatatcgtggatgcagactgggaaagattatgtgaggatttacaaaaagaaggtacgaattatgaaggaaatatcgaagatttgtttcgggcggagttatatttgatttcaccgataacagaccccgtccgttttttaaaaaaggaatatttcctgacttctcagcaaagagatattgagaaaaagattttaagagatatttatgtaaagcaatcaggatgtttttggtttagtggaattccgggaacaggaaaaaccttgcttctttatgatattgctatgaagctgtctgttcgccatcgaatctgtatggtacattgcgaggagaatggagaaaagtggagaatattacatgaacgcttacaaagaattgattttttggcagatgagcagattcgcatcgagaagaaaagtggcagtcagaatagcgggcaggataaaggaccagatagcagccaggattatgatcaaaggaagcaatttaattgcgaagaaagaaaagccggaacacaaataccgcttgaaaaatatagagggattttagttgatgaggcacatttgctttccaaagataagatagagagattgttagagttaagcaaagagcagcctgtgatattttccagtgattctgaagatgttatctcatcagaagaaatggataaagagaatataaaaaagttggaaaatcagacagatattaaggtttttcgattaacaaatcgtattcggacgaatgcggaactttctacatttattcagaatatgatgcatttgccgccgaggatgaattcaaggggatatccgcacatttttgtagtatatgccaatgatgatgttgaggcagagaatttgctaagtgattatataaagcagggataccagtgggttgaaatagaagaatcggagaggcaggaagcgcaggcagatttaaaaatgcaggcggtcagagatatggataaaatagttctgctgcttgatgagcggtattattatgatgaagaaggatatctaagggcagcctgttttatgaaaaatggaagttcatatgtaagaaagatttttcacaggttgaatcatgcaagggaaagtatagctttggtagtaaagaataatgagaaggtatataatacgttgctggatttattataaacaaaagaaaataatggggaagtgctaaagcgtgtttgaaaaatcattcctgcaacctgcacgccccaatttgcggtatattttgccttcattcagttgacgtagcccgctacgccgccctcattcagacaaaatctcccacaaattgtgacgcacatcttgcagaaagcatttttcgaacacgctctaaaaaagtgtattttatcaagtgggttctcgctgcttttttgctatagtttgtgctataataaaaatgattttttttagaggagacatataatgctagattttgtaaatgattattcagaaggcgcccatgaaaagattttactgcgtttgttagaaacaaacatggaaaagttgtccggctatgggacagatcaatattgtgagtcagcaaagcagaagatcagggaagtctgtgaatgtccagaggcagatatttattttttagttggtggaacacagacgaatgctacagttattgatgcgatactaagtcagtatgaaggtgttgttgcggcaaatacaggccatatcagcacacatgaggcaggagcaattgaagcatccgcccataaagtgttggcaattccgcataagaacgggaagattactgcaaaagctgtaaaacagtattttgcagatttttatgcagacggcaaccatgaacatatggtttttccgggaatggtgtacatttctcatccgacagaatacggtacactttacagtaaaaaagagttggaagagttgtctatagtctgtcatgagtatgatgcaccactttatttagatggtgcaagacttggctacggtcttgtcagtgaagaaaatgatgtgacactagcggacattgcttctttatgtgatgcattttacatcggtggtacaaaggttggagcattatgcggagaggcagttgtatttccgaagaataatgcaccgaaacatttcatgactacggtaaagcaacacggagcacttcttgcaaaagggagagtgcttggtgtacagtttgataccctttttaccgataatctgtattttgagattagtaaaaatgcaatcaaaacagcggatacattgaagcaggctctaaaggagaagggatatactttttatattgactctccgaccaatcagatttttcttgtattagaagatgaaaggttgaaagaattagagcaaaaagtagcgataagcttttgggaaaaggcagatgataaccacacgatcattcgtcttgctacaagctgggctacaaaggaggaagagattaaagcattgattgaaatcttataaattagagagtatatttattatttttaagaaaaaagtatctattacaaagacagattttaagaaaagaatcaaagatatttttatgactttcacgttatggaattctgaccaaaaacttcgagagagttatcgagaagttttgttttggggcagaatggaatgtttaacgtgacggaataaaaatactttggattcttttcttaaaatcgtctgtagacaagtatagtttgaaagggagcatttttatgggtttaaatgataccccatccggggaaagaatacatattggtttttttggcagacgaaatgctggaaaatccagcgtggtaaatgcggtaacagggcaggagttagctgtcgtatctgacacaaaaggaacaacaaccgacccggtctcaaaagcaatggaacttcttccgttaggaccggttatgattattgatacgccaggttttgacgacaaagggcatcttggagaacttcgtgtccgcaagacaaagcagatacttaaccgtacagatattgcagtacttgttattgatgctacagaaggaataaagcagtgtgaggaagaattgcttgctatttttaaggaaaaagagattccatatctgcttgtatataataaggaagatattctttcagaagaacagaaaaatctgttgcgtacagagcaatctgaacaggtaaatagtatctgtgttagtgcattagaaaaaaaacacatcaatgagttaaaagaaaaacttgccagactggtaaagacagataatcagaaacttcagcttgtcggagacctggttcatccggcggatcttgttgtgcttgttattccgattgataaggcagcaccaaagggaagattaattttgccacagcagcaggtaattcgtgatgtattagaggcagacggagcggctatttgtgtgaaggaatatgaacttagagaattacttgatacgattggaaagcgtccggcaatggtaattaccgacagtcaggtatttgcaaaagtaagtgcagatgtgccagaggaaattcctcttacttccttttctattttaatggcaagatacaaaggatttcttgaggaggcagtacttggagcggctgccattgacagactaaaagacggtgaccgtatattgatttcagaaggttgtacacatcatcgtcagtgtgatgatattggcagtgtcaagattcctcgctggttgaaaaattatacaggcaaaaagcttacaatcgagacgtcttccggacgggaatttcctgaagatttatcaccgttttcactgataatccactgtgggggctgtatgttaaatgaacgtgaaatgaagtaccgcatgaagtgtgcgaaagatcagaatattccatttacaaactatgggacagcaattgcttatatgcaggggattttggagagaagtattggtatttttccgtatcttttagaagaattaaagcgttaaaagatacttcaaacacactttaaaagacagtaaaggagcggagtactttgagattagaaaaggatacccttggagaaaaatatttaacagatgaaaccgtatatggaatcaatacacaaagagctgttgaaaactttccactttctcataaaaaagtaaatctgcatttgattcacgcaatgcttctcgtaaaaaaagcggcagcaaaaacatatgagaatcttgtggaagatatagaaaaagaaaagtatcaggcaatcgtagcggcatgcgatgaattacttttaaaaacagaagaggacaaaagtttttctcagcaggcggaacataatcgagataatcaaaatcaggcggaagataatcgaagaggaatagatgccctgtttgttacacaggcattacagggcggggcaggtacatcgacaaatatgaatgttaacgaagtcattgccaatatcgcattaaaacatttagggaaaaactatggagactataactgtattcatcccttagacgatgtaaacagaggacagtccaccaatgatgtctatccgacagcacttcgaattgcctccatttttcttatcagaaagttaagcgatgcctgtgcagcattacagacttccttacaggaaaaagaaaatgcctttcaggatatcgaaaagctaggaagaaccgagtggatggatgcggttccaatcacgcttggagaagaatttggtgcctgtgcccaggcaatcgcaagagaccgctggcgaatttataaagtagaagagaggcttagacaggtcaatcttggtggaacggcagtaggtctttccgataatgcacagcataaatatcgttttcgtgtcatagaggaattgcgtcggcttaccggacttggacttgctgcagccgaatatccgatggacttaacacagaacaatgatgtgttcgtggaagtctctggtttattgaaagcactggcagtaaacctcatgaaaattgccaatgattttcggattatgaattccggaccaggagggggcattggagaattgcacttaaaagcaatgcagcagggcagcacaatcatgccgggaaaagtaaatcctgtcattccagagatgactatgcaatgtgccatgcgaatcatcgcaaatgataccgcaatcacaatggcagcagctcatggagaatttgaactcaatgcctttttaccacttattgcagacagtctcttagaaagccttgaacttgcagaaagagctgtcacgatcttcagggaaaaatgtgttgaaacgatagaacctgatgtggaaaattgcaaaaaacacttagaacaatcctatgcttttgcaacggcctatacaccgaagttagggtacgaaactgtggccaaaatcattaaggaaaaccctccagaaaaagcaaaagaaattttgatttgtgaggctgcaaagcagacgaactcctgaagctaaataaagcatatttgtgactttagtcgcggcggtttgaatgttcgcttaaagcactcacatccaaaccttgctccgaggccacaaatatgctttatttagcttcaggagttctgtgcgttgacagctcagaaaaccagttagaggaatttggaaatttccagaaagactgtggttttataagaaaatacgcaggccttttacaaattcataatattctggagaatccccaaatctctaacatgaattctgattttgtaccagcatccacagtcagccagcaaagagagcctatcccctatatttgtggcctcggagcaaggtttggatacgagcatatgaagcgagtgttcaaaccgccgcgactaaagtcacaaatataggggataggctctctttgtgagcgtctgtttatctagataaatcagaacttcttgaaatattttttcgtttctgccacgacaactccattcaatgcgagaagcgcaatcaggtttggaatcgccataagaccatttacaatatccgcaatagtccatacagcagaaacagtcatgtaaggtccgataaatacgcaggcaatgtaaatccagcgataagcacgaactactttttggttattgcctgtcagataatcaagacatctttcactgtaatagtcccatccaagaattgtagtaaatgcaaagaatacaaggcaaagcattaagataaaggcggatacctttgcagggaaaggaagtccaacctggaatgctcttgttgtaacagcaacaccttcaagtcccttgtcccagcttccggtaatgacaatggaaagcccagtcattgtacaaatgataatggtatcaataaccgtaccaagcatagatacaagtccctgtcttacaggttctgtagtctgtacagcagcagcagcgattggtgcacttccgataccggcctcgttagagaaaataccacgggcaatacctttttgcatagcaagcatcatagcaccaagagcaccaccggcaaccgcacgcataccaaaagcactctgaacgatttctacaacagcaccaggaatagctttatagttaagaattaaaattacaacagcggcaataatgtaagcggcagccataaatggaacaacaacctgtgctacagcagaaattcttcgaagacctccaataataacgaaagcaacaaaaattgttaaaataattccggcaataacaactgtccaagaataatctcttccaaataactgtacggtccatgcattgtttgcatcaaagaaattatttaccgcactggtaataccattaatctgtgagaaggtaccaatacctaaaagacctaccataacaccgaaaacagcaaagattttcgcaagccatttccagttttcgcccatacctttttctatgtaataaaatggtccaccgacgatatgtccatcgtctgcaaccgttctgtatttgatggcgagaagacattcggagtactttgtagctgtaccaacagtggcagcaatgatcatccagaaaagtgcgcccggtccaccagcaacgatagccgtagcaacacctacaatgttaccggttccgatcgtagcagaaagagcggtacataatgctccaaaactggaaatttctccgtgttctccatccgtttcattcgagaacatatacttaaaagcgaggataagtttacgaacctgaatacctttcaaacggattgtcagaaagataccggttgccagaatcatgacgattaacgggaccccccatacaaatcatcaattttggttaagattgagttgattgttccaaacatactacttgttttgacagactatgccttcttaatatgaaaggcataattctatctttcctttcttaatagatttttctgtgtgaaatacaatatgaataaccatatcacaattgattctcctgaaaaatcatctcggaaaaggggaaactgcctttgcaaagtaagaattcacagttttctaaagacacaaaaaggactgatacccattatcagccctctaaagagtaaacatgcatttatagtgccctgtccttttgcctgagagattagcagatatactgccgtacaccttcggcgctttacattgaggtaaagactctccagagagtaatgctgtattgttatatagcaaacaatactaaaatagcacagaataaaaggtatttcaacatatttttgaaaaaaatgcaagatatacgtaagaaaattgcaaaaagttagaattttgctgcaatttatagacagagtggaaaccaagttatgagagggtagagcgtgtttgaaaaatcattcccgcaatctgcacgctccaatttgcggtatattttgccttcattcagttgacgtagcccactacgccgccctcattcaggcaaaatctcccacaaattgtaacatacatcttacagaaagcatttttcaaacacgctctagaacttgagataatagtatattattgctataatatatttatgatcaaaattttataaatcaagtgaataaaaatggataaatataaggaacttacttgtgtaatttgtataattatagaagctataaagttttgctgtacttatatttatctttttaagaatagcacattaaggaatagtacagattttacaatgtttaactatcaaaataaaatatgtgatagcagcaaaattaattttaaaggagtttttatagatgaaaaaacatttacagaaatatttatttgaggaaaaagtttgtaatcttgtgacagaaatttcttcaaaagaaacaggagggataccggagtcgaatacaaatgttattttaaaaagaaaaattatagagcagacagaagaagatttttcttaccagcctattcttagaaaagaagaaaatgcatatcgtttctttgaaccaatcgcaaaggaagaacgccttatcgttctcggtggaggccatatttctggatatttatgtgaatttgcagccaagacaggatttgatgtctgggttgtggatgagagagaagaattttccaatagagaacggtttcctcatgccaaaaaagtgatttgcggaaagtttacggatgtgcttccaacattgaatatcaataaaaacgattatgttgcaattgttacaagaggacatagctgtgacggagattgtctttactatattttaacccatgaactcccagggtatcttggaatgattggctccaaaagaagagtgagtgcacagtttaagatgtttcgtgagatgggtgttcctgaagagaaaatcgcacaggtacataacccgattggtctgccgattaatggagtgactccgccagaaattgccatttctattctagcagaacttattttagaaaagagaacgaaaaaaacagatggaacggtgcagacagagcttgactatgaggtactattagagtggcttaatggaactcgaccatgtgcgatggcaacaatattaaaagcacagggttcttctcctagaaaagaaggagctaaaatgttaatttttgaagataaatccattctgggaagtgtcggaggaggtttagcagagagtaaggttatcgaaaaaggacacgaaatgattggcagcggcggggcatttttattccattttgtgatggatgcggatgtggcagcgcgtgttgggatggcgtgcggcggtacttttgatatactgattgaggatgttgttcgggaataacagagaatagtaaaaagacgaaacattgaatttagacaaaaatttattgaaaaaataaaagaggtagcaataatgaaattaatgaaaacacaggacgcagtagggcaggtactgtgtcacgatatcacacagattataaaaggcgttaccaaggatgcagtttttcgcaaaggacatgtgattacagaagaagatattccagtattactaagcgttggaaaagacaacgtttatatttgggaaaagggagagaccagacttcacgaaaatgaggcggcagaaatccttcgggaaatgtgtcagggagaatatatgcatccaacttcggtaaaagagggaaagattgaacttgttgcagatattgacgggcttttaaaagtagacagtgacaaaatgaaaaagatcaatgggatgggggagctgatgattgcctcccgtcacggaaactttgcagtgaaaaagggagataagcttgctggaacaagaattattccgcttgtcattgaaagagaaaagatggaacaggcaaaggcagtctgcgggggagagccaatccttgaattaaaaccatttgttcataaaaaagtcggtatcgttacaacaggaaatgaagtctattaccacagaattgaggatactttcactcctgttattaaggaaaaacttgcagaatacgataccgaagttatcggacagaaaatctgtaacgatgatcatgaaaagattacaaaagcaattctttcctttattgaaagggggcggaccttgttctttgtaccggtggaatgagcgttgatccggatgataagacaccgcttgcgattaaaaatacaggagcggaaattgtttcttacggagcaccagttcttccaggagcaatgtttttattaagttactataatggaaatattccaatcataggattgccaggctgcgttatgtatgcaaaaagaacgatttttgatttggcacttccacgcattatggcagatgatgaaataagtgttgaagagttggcggcactgggagagggcggtttatgtttaaactgtccagtatgtacattcccaaattgtgggtttggaaagtaaaaaagaaaggaaaaaatatggaatacacgcattttgataaacatggaaatgctgttatggtggatgtgagtgagaaagcagtgacaaagagagttgctgttgccaaaggatctatccgcatgagtagagaatgtttcgataaaataaaatatcaggacatgaaaaaaggagatgtgctgggggtagcccgtattgcaggcattatgggagcaaagaaaacttccgaattaattcctttatgtcatatcttaaatcttacctctgtaacagttgatttcatcatgcaggaagaaagcagcagtataactgcagtctgcgagacaaaaacaacaggaaaaacgggtgtcgagatggaagcgctgacaggagtacagatttcgctccttaccatttatgatatgtgtaaatcggtagataagacaatggaaatttatgaagtctgcctgtgcagcaaatctggcggaaaaagcggagacgttgtctacaggacagtagatggtgaataattatgcgttatcagattgaaaatggaaccgtttctcttggaggcaagaccatcttaaatcatattgatttttcaataaaaggacaggaaaaaatagcggttgtcggacgtaacggagcaggaaagacaacgcttttacgtttaattagtggggaattatccttagatagagatgataaacgctttggaaaaggaatcacaactgataaagcgatttcaatcggatttttgcatcagcaaagcttttcaaatgcagagcggaccgtagaggaagaaatattgtctttagtaagcgaggaggatattttctccaaagaaaaatattattttgagaaagaatatgaccggatttttactggatttggctttaaaaaagaagataaatgcaaaaaaatcgggcagttttccggtggagagcagactaagctggcatttattaagcttttattatcaaagccagatattttgcttctggacgaaccaacaaaccacctggatattgcatcagtagagtggctggaagaatatcttgtctcctatgaaaaggcagttattatggtttctcacgaccgatttttcattgaccgtactgcagaaatcatttatgaactttctgatgggaaattaatgcgctatgtcggcaattatacagaatataaaaagcaaaaggaaaagcaaagagtgtcccagcagaaaaaatatgatgcacagcaaaaagaaatagcaagattaaatgaactgatagaaaagtttaaacataagccaaaaaaagcttcgatggcacgttctaagaaaaaagtgttagagcggatgcaaaaagtggaaaagccagataaagaagaagcctatatttttaaagaaaagttagagccgcttatgccaggagcaaaaaatgttttagaaaccgagcatttaaagatcggctacaaaaatcctatcagggaacttaccctgcgaatccgacgagggcagaaaatagcagtacttggagctaacggagcaggaaaaaccacattttttaagacaatcattgggcaactccagccaatctcgggaaaatatataattggcaatggaattgcaacaggatattttgaccagcattccggggaaatacagtcagaaaaaagagtagaagagcattttggcgaatgttttcccaaattaacagaaaaagaaaaacgtcagatattaggaagatatttgttttcctctcaaaaggcaaatgtaaaaatccgtgatttatccggtggagaaaagagccgcttaattctggcagaaattcttgaaagccgcccaaacttcttagttttagacgagccaaccaatcatatggacttaccggcaaaagaaacgatggaatcggcattttctgcatatacagggacaatgctgttcatttcccacgacagatactttgtcagcaaaattgcagatgccttgttattattcgaagaagatggtgtaaaatactatccatttaactatgagcactatcttcatatgctaaagaaaaaaagagaaggcgatcagacctgggcagacgtggtagaagcagaaaatactgccttagtagaaggacttctatctgttccggcaaaagaacgccatcagagtgcccgctttaacaccgaacaatcctacacagactggcagctgactctcgccagagaacagctcgaaaaatgccagaaaaatatagaatactggcaaaaacaagctgctaccgagttagataaccttacctttgagcaataccaatcagagaaatggacaaaaagacagagagaactccacaaacgattcgaagaattatcagaagaatatctacagcaaaatctcatctggtatgagaaatatcaagaatatgaggaggctttttctgattatcttgaatagacaattctgatttgtgcaggccaaaacagacgattttaatgtttcgtcagctttgcctgcagcaaatcagaatgctgattctgccgaccgcatagtaagagtttcaaccgtagagcaatatttatcaaccaggcacaccaacagcgcttctctacaccgaggcagttttgtcaaattcagcggccacatatgatgtgcgataatatcccgctctttatcggttagagcaaagcgggcatcagcattcagcaaggctgtgtgcgcgtgggagaatccatgccacttatggctgtcatctttttcgtgccagtcgtaaagatagaagtcatgaagaaaagcaccgacaacgagggactttacatctgccccaagtccgaagtgtttatttaagtaataacatactcttgtgacgtacataacatgtttataagtgcttacactgccgtgctggcagaaatttttcatggaaagtgcctctttggtgttgcaatatttttctaatatcgtatcaatttcctgcatttctgcattgcttaacttcatagatgaccatccttttttattttaataaatttctatatttttacttagattacttcggttttccagtaagccacgctatatggtggaagatccatcccaccgccaaagtcaacagtttctcctgtaacaagatctgttccaagaccggagcgcgcattaaaatcagcatgaaatgtgttggaatcggcattgattgcaacaataacacgttcctcatcacagcttctttcaaaaatgagttgtttatctcttacaagaagattcgcatagccaccgttgtataaagccgggtgagtgtggtgtgctttcgcataagcggcaattgcatcagaaagttcgttccattccggtttttcaagacgaggacgaatctcttcatcacgtccctgttttttaccttcaatgccccattcgcttccataatatatagaaggaacacctggcattccaaatagcaggccataaataacaggcagctgctgtttatcctctaatatagtggcaatacggctgacatcatggttatctacaaaagagagaagatgctttccgcggtaaatacaccagttttcataaccaaactggcggtttaagctgtagctgatctcatgcatgttcgcacagttaaaactggaatacaatcctttgtaacattcatagtttgtaacagaatgacacttctcatcattcatatacatattataatcgccatgtaatgtttctcccataagaacaaaatcttctttcagagtactggtaaaacggcgtagctcttttaagtaaaaatcactcagacagtaagcaacatcaaggcggagaccgtcaatgccataaaggtctgtccactgtttgattgcatcgaactgatgctgtctgacatccggattatcaagatttaacttaacaagttcgttatgtccttcccatccctcataccagaatccatcgttatattctgtatttccatcaaaacttaaatgaaaccatccacaatatgggctgtcccatttcttttcctgcacatccttaaatgcccagaaaccgcggccaacatgattaaatacaccgtcaaataagattttaagaccggcttcatgaatagcatcacatacttcctttaagtcatcgttcgtgccaaggcggcggtctacagtgtaataatctctggtgtcatatccatgatagtcactttccataagaggattaaaaagaatacaggtagcaccgagctttttaatatgagaaatccagtcctttacttcaaggatggaatgtcccacgacactgtcatcgctgcttctttcttcatttaaaactccacagagtcctaatggataaatctggtaaactactgcttcatcgaaccacataagctgtccctcctaaatatagaaaatgctcgtcagctttaaaaaattgagcctccgagcattttcattatagcataaattctgttaagattcaaattggaaggtccaattcaggcatacaatttgaagaaaaaattatgctgcgatataaggggagattgccttcatgatcgttggcatctcattttctctttccatgattcttaaatcaactttgttgcggatatccatagtcattactccaagaagagacttggcatctacaacgtactgtccataaattaagtcaaagtggctttcaaaatcttcaatagcttttacaaatgatgtcgcattatccacagagccaaacttgattgtgactgttttcataattctacatctccttatcataaatgtatattataccgataaatagattgccggtataaaaataaatttttactaaatcgttttgacgattttggcttataatatttcatataaggcaaaaagtcaagaaaaattttcagaagaaagaaaatcgtaaaaaaataaagtgaatatattttgaaagcttcttgcattttttattcaaaatagatataatagaatggtgagtataaaataataagaattaagaaaggaaggatacattatgaaaaaattcttatctgtagctttagcagcagttatgatgttatcattagcagcatgtggaagcagctcaaacaaggcagaatccagttcagaaggaggcagtgcttctgataagacttatattatcgcgacagatacaacttttgcaccatttgaattcacaaatgataaaaatgaattcgtaggtattgatgtagatatcttagctgcgatcgcaaaagatcagggatttaagtatgatttacagtctcttggttttgatgccgctgtagctgctcttgagtccggacaggcagatggaacaattgccggtatgtctatcacagaagaaagacagaaaaaatatgacttctccgaagcttactatgattcctatgtatgtatggctgtaaagaaaggcagtgacatcaagggatatgaagatttaaaaggtaagaaagttgcagcgaagacaggtacacagggagctgactgtgctgagtctttaaaagataaatatggatttgatatcacatattttgatgattccgcaacaatgtaccaggatgttaagacaggcaataccgttgcatgtttcgaagatcagcctgtaatggcttatggtgtttctcagggtaatggtcttgaaatcgtagcagaagagaaagataacttctccacaccttatggttttgccgtattaaaaggacagaacgcagatttactcaagatgtttaatgaaggtttaaagaatattaaagcgaacggtacttatgatgagatcgttgcaaaatatacctcagcgaaataattgagagacaaaggttaggtaagaggttaatttatgaatctatttggagttttaagtgaagtctatccaacattgttgactggacttactatgacagttaagattacgattctatctctgatcatcgctttggttatcggtattttcgtatgtcttatgaatatttccagtaatattgtattacgtggaatcgcaaagttttatatttggctgattcgtggtactccgatgctggtgcaggcattttatttctattttgctctgccacagttagttcaggcggttacaggctcacagttccgcattaccgtatttacagccagtttagttacacttgccctgaatgcaggcgcttatatttctgagattttccgaggttctattgagtccgttaataaaggacagatggaagcggcaagaagtcttggtttaagttatgcaaagtcaatgcagaagattattcttccgcaggcagtgcgtatctgtctcccatctcttgtaaaccagtttattattacgttaaaggattctacgattctttacgcaatcggtttatcagaggttatgtataatgcaaagatttatgtaggaagaacgatggaatcatttgcaacatatacatgggtagcagtcttcttccttttgatagtgacagttctgtcatttatctcaagatatgttgaaaggaggatgaatgcgtaatgacaactgaaaaagatgtaaagattcatgtaaaaggtctaaagaagagttttggacatgtacatgttttaaagggaattgatgcagagattaaagccggtgaggtgatctgtgtcattggatcttctggttctggtaagtcaacatttcttcgctgtctgaatcgtttagaggaagcaacagccggagagattcttgtagatggacagagtattacggaaaagaattcaaatattgacaagattcgtcagcatatcggaatggtattccagcagtttaacctgttccctcattatacagtaaaagagaatattatgcttgctcctgtagaacttaagttaaagtctaaagaagaagcagaaaagaaggctcttgagctgttaaagcgtgttggcctggcagagaaagcagatgcgaagccaaaacagctttccggtggacagcagcagcgtgtagcgattgcccgtgcgcttgcgatggaaccagatatcatgttatttgatgagccaacttcagcacttgaccctgaaatggtttgtgaggttcttgatgttatgaaagagctggctgcagagggtatgactatggttgtagttactcacgagatgggatttgcccatgatgtagcagacagagtatttttcattgaccagggtgttattatggaacagggaaccccggaagaggttatggaccatccaacaaatgagagaactcagagtttcttaagtaaagtattataaaatatttataaataaaaaggcatctgttcgcagcaggtgccttttttaggaggttattatgcgaatcgttgtaaaagtgggaacatcaacattgacccatacaagcggaagaatcaacatcagaagaacagaaaagctttgcaaaatcttaagtgatgtaaagaatgcaggacatgagcttattttggtatcttccggtgctatcggtatgggtgtcggtaaactgaatatgaaaagtaagcccgaagatatgcccacaaagcaggccgcagcagcgataggacagtgtgaactgatgtatctttatgataaattattcagagaatataatcatatcgttgcacagatgctgattaccgggcttgacttttcaaatgaagaaagccacaagaattttcagagtacattaaaccgtctgttagagttaaatgttattccgattatcaatgaaaatgataccattgcaacacaggaaatttctgtgggtgataatgatacaatgggagcaatcgttgcagagaatgcaaatgcagatttattgattattttaagtgatattgatggtctttataccggcgacccgcgtaataacccggatgctcagttaattgatactgtattttctattactccggaaataaaagaattagcaggtacaaaaggaacaacacttggtactggtggaatgattacaaagattcatgcggcagaaatctcaatgaatgccggcattgatatgattattgctaacggaacaaaaccagaacttctctacaatatcattgatggagaaaaggtgggaacaaagtttatcgggaggaaaaaagcatgacaacaaaagagatactgacacaggcagtcacagcgaaaaatgcgattaactcagcagataccgaaaccaaaaacaaggcacttgccaatatggcagatgcccttttagcacatacagatgcaattttagaggcaaataaacaggatgtggaagcagcaagaggaaagatttctgatgtcatgattgaccgcttaatgttagatgctggtcgaatcgagggaatggcaaagggaatcagagagctgattgacttagatgaccctgccggaaaagtattaagaactgtagaacgcccaaatggaattgtcattgaaaagacagcagttccaatgggagttatcgcaattatttacgagagccgtccaaatgtaacaagcgatgcagcagccctttgtattaagagtggtaatgtctgtgttcttcgaagtggaaaagaagcgtggaagagtgcgaatgctgtagttactgccttaaaagaaggtatggtaaagtcaaatcttccaggagaaggcatccagcttatcgaagataccagcagagaaagttctgtagaattgatgaaagcagtcggttatgtggatttactcattccaagaggaggccctggccttatccgttcctgcgtagagaacgccaaagtaccatgtattcagaccggaacaggaatctgccatgtctatgtcgatgaaagtgccagttttgagaaagcattacaaatcattgaaaatgccaaaaccagccgcccaagcgtttgtaatgcagaagaagttcttcttgtccacagtgcagttgctgaaaagttcctgccattattacagaaaaaattagtagaagaacgaaaagaaaaaggtgaaattccggtggaactgcgtctttgcgatagagccgctaaaattatttcaggaacaccggctggggcagatgattttgatacagaattccttgattacattcttgcggtaaaaatagtagatagcgtggaagaagcagtagagcatatttcaaaacattctacaggtcacagtgaagcaattatcacagaatcaaaagaagcagcagactattttactatgagagtagatagtgccgcagtatatgtgaacgtttctacccgcttcacagatggaggcgaatttggactcggatgcgagatgggaatctccacccagaaacttcatgccagaggaccaatgggcttagaagaattatgtacttataaatatatcatccggggagaaggacagattagatagtaatttataggctaaaccgacgaaggcaggaaacgaaatacgctatatttgtgactttagtcgcggcgcgttgaatgttcgcttaagcgctcacatccaacacttgctccgaggccacaaatatagcgtatatctttactgcattaaggttaaaaataaaacagccctcataagttcttattatatagaaacttatgagggcgtctgtttattctcaaccttaagctgcaacctcctgttgtcgtttgtcaaggattgctttatattcatcgcaattatctgctgtgatattctcaagctcgtcatccggaagaatacgtttgtcgtagttccttctgaaaaatccccttaaatatatgagaaatgcagaattgtaaatctttcttgtaagtcttaaaatttcatcgtgatcaatctcttttaaagcatgatataaagcgaagaaatcatcagtatcaagatgtgcaaactgtaaagtctgctctaataaaacatcatcgttctcaaaaagagagatataaccgagaagatacattaactgacggaaagtcataacgaaatcattcggttcaagtgtttcaagaaactgttcaaaacaaacttttactctccaaagcccctcctctaaaagatgacggatagaaatctcattaaatggccctggaatctgaatcttgtctatatgtacagtttttagggtaaggcgttccataaaacgtgccagtgtaacacggcaggcatgaaattcagaataggcattcatataaataaataagtcttctgtctcatcaaaagaactgtttatgaaatcataaaaatgagtaaattcatggaaaaggataaaacgggcataactgtcactataaagatgaaaacgaggattcaaatgcagaatgtacttgccgtcaagaagctctaaaatgttaaaaaacccctcaacatatttctctgcatcatattgcacagccgaaatctgcacatcctttggtaaatcatacttttccttatattcattccacaattcattaatctgtcttaaattcatatgtaacccgccttcccataacatattgcttatattatataacactcatatagaaataacaacgctcaaataggaggaagacggataaattattgtgatttgattcaatagacggaaaaagggaggttagagcatgtttcaaacacgttctagaaggttttacataatttctattatttgaattgaaatagcaggtggaaggtttgtcaaatctttccttaaaaacttattttccaatatctgtaccaatactacattgaggcggccaaaaaacagaatcccgaaagctaagtactgtatatctgtggcctgggagcaaaggttagatgtgagcgcgtaagcgaacgtttaacctgccgcgacgaaagtcacagatatacagtacttagctttcgggattcgtctgttacttcaatactattccgctttatagtagaaaaaagtttgcaccatcaatgtgccttcttctaaatccttctggcttacccagtctccgaaagaagaagtccctctttttgggagataatggggatccattaacagatatttatctttttttgcattataatcaacaatagtaccgtaatgtcctggaagataggcgatagcagtatctccttcttttaacttttcctttaattctttaaaggattcgccgcttccatcgtaggagaatccatatttatagccaaatttttcggcagctgccttaaagaatccgctgtcagtaccacaatcttcgatgcggtaatgcttatcagaagcgtattgtgccagttcataaggatcaggaaaatggccacttaaagagtagatagcatttactgtggcaaaaataccgcagccggaagtgcaaaaattatttgtgtcagtatcttttgtggtttcattgccgtaatgatgctttgcccagacagggtcaaactggacaaaaacctgaagattttctttttcgattgcttttttattacgggtcagacgccatacggcattagaatctgttgtgaactctaaaatactgccatcgttttgagaaagatttcttttggtagtttcatcgcagattgtataatagtccttttttcttgtaataagaaaagtaccagcttcctgtttacttccccaaagttcatttgaagaaggtgtgtttgataatgtatctgcttttaaatatttttcttctcctgctttgcgtatggtgtaacggttgtcaccagcatatttaaaagaacaggaaaaattttctgagataatagaagctgtattcatagcaaaagaagaatccgaggaattctcctcataaaaagaaagctgataggtaccgtttgaaaaaggctgtttttctctgccatcataaatcaggcaatcagaatgaaattcatctcttgttacccagccattctttgttccgccttttttagaagcatactgaatttcgtaccaggaaccggaagaaccgattactttgacaccggtatatttagggagtacagtttttaaatcattgctgtaatcagaatagtatacgggcagttcatttcttgctagggcataaataaagtcagatttgctttcgtaggcatgttgaaaagcgaaagtttttgacggaataaagaaaaatccggtcaacattaaaagaacgcctaaaaagatatgttttttcacaacaattcctccattaatgtattatgtgtttgttcctaaagtcttttctacacttgactttgtaaaaaagattccaggagaacatgattataagatgtttttacagatttaaaataaaaaataagaagcatctattcattattttgtattttgaagatattaaatagttacaaatgtcttacaaatattaaaaaagtgttacaacttgaggtattatagcataaaatatcgaatttgcaaacaaacatctttagaaaattgtataaggaattgtgaagtaagatatagaaaatgaattgagataaacaacaatttatggtaaaattagacagagtattctacttgtcgtggaaatacgatatgaaaggaatgaagaagaatggaacagagaaagaaaatttttggagcattagatgatttaatgcgttcaccaatcggggatagactcagagagagggtgttccgggaattatctacaaaagaaatacatgatttgcttcagagagagcaaaaaccatataaagaattaatggcatattaccagtgtgcgcttatggaagtagagacaaagtttcgtgtgctgaatgaacagttttcactggcacatgacagaaatccgattgagtcgattaaaacaagggtgaaaagtcttgagagcattacagagaagttaaacagaaggaatcttcctttttcaacgcagagtattgaggagaatcttacagatattgcaggaatccgtattatctgctcatttagagaagatatttattttcttgcagattgtctgctagagcaggatgatatcacattgattcagcgtaaagattacatagagaatccgaaggagaatggctatcggagtctgcatttgattgtggaagtccctatctttttagagcataaaaagaaaatgatgaaagtagaagtacagcttcgtacaattgcaatggatttctgggcaagccttgaacataaattaaaatataagaaagatattgcttctgaccagcttacagcggatttaaagaaatgtgctgatgagagtgccgcccttgatttgaagatggacgcaatccgcaaagaaatagaagttttgaaagcaccggaagcaaaagcaataggaagagaagtgaagcatctgccggggggaattctgaacgaaaaccaataaaaatatataaggcatataaaaaaaacaggtataaataccgaaaaaagacatatgaaagagatatagggcaggagggctgtatatgatttatatgtctttttttattggactgattcttatttgtaagggaggagactggtttgttgatgctgcgtcaaaattatcggaaatacttggaataccgaaatatgtgatcggagcaacgattgtgagttttgcaacaacgatgccggaaatcattgtttctgtggcggctgcgttagatgggcattctgccatggcaataggaaatgcagttggttctgtttctgcaaatacaggaattattcttgcgcttagtttattttttcttcccgttgcaattaaaagagaagaatatttatttaaaaacagcttatatattggaacattactgttgttattgattagcttcaaagatagaatatttgacagggcagattgtctcctgctattacttgccgggattttatttcttgtagagaatgtcaaaaatgcagtttgtaaaaaagaagtttccaacagtaaaagaaaaaaagaagatatgatattacataaaaaaatacaggctgggaaaaacggagaaaaaaaggtaaaaaataaaagaagtaaatggaaagaaaaacaaagtagtatatgggaaacatttttctggttttgtataggcgcggtgtgtattgtagcaggttcagagttactagtacattctgcctgtaaaatagcggaaattctgcatatcagcgaagatattatctcggtaacgattgttgcaatgggaacatctttgccggaacttgtaacaacagttacagcaatcctaaaaaaagagtcttctttgtctgtcggaaatattataggtgccaatatgatagattccgcttttattttaccaatctgtacattacttagtggagagaaacttccagtttcactgcagatggcacaaattgatatgcctttatgtatccttatttcagtacttgcgcttcttcctatgttaattcgtcagaaaattaaaagaagagatggtatccttgttttttccatttatgctggatatctattatatatctgctgggctatataatgtgaacatatttgctttaccctcttctaacaagaaaataaaaagaatcattagctcataaaaatacctgtctgataaacaaaatagaatgttgctcatgttcacagacaggtaaatttaatgaagcaatgcttcttttattagaaaattatttaagaccgtttaaaatactcatagcataagagtaaatcttcttatttcccttaatactaggatctgtagggtcaattcttttctttttatttttaatctttccagtagttccggctaaagtataaacaccgaaaggtcctttttccttgttctttctgattactttaacccagacacgtttcttcttgtttgtctttgtagcaatatcatagataagttttgcattgacagcctgaagacgaacgcttgttgttgtctggtttgttccaaggtcgttatataaaccaacttctaactttctgttatttgtagtagtgtatcgtgcagaatggaaatagaagttaccatgttttaccttaacaccccactggtaataatgatatggacggcttttcttgtagatgaaccatcttacagcagaagttttttccagacggcatccagaataagcctttgttccttttgcctttcttgaagtagagcaaaccatagtctttaatggaatgttatacttgccagtctttttatctttggcataaagagtagcattatgtgtctttgtgttaacaacgatcgtaatgtctttcttaatccattttttgtagttaagtgtaaataaatccttaactaatactccgtttttgttaaagtagaatttgtactttttcttgtcatagtagctctttaatgtatgccagccagtaactttcttaccattttcgtagtagtatacttttttaccctgctgataccagccaacaggaacttctgtagtagctgctgaagcattcattggaatactgcccattaaaatagtaacagacagaataagtgccattaataacgatgtaacttttttcattatacctttcctttcttttgtgatttaatatctataatagtataaaggaaaagaaagataaagtcaataaaagagccttttctgaaatttgcgtggaagaagatggaaaggcttttaagagtgtgtttaaaagaggtatttaaacatgctccaggaaatgatatttaagtagtggccgttgtcgtgtttggttaaatgagaatcctcgtagagcgtattttaaagaaagagttgacaataagaaaatacagtgttatatttcaactagaacaaatagaattcacaacgagagggtgaagattatggtaacaaaaacagattattatgatgttcttggaataaataaaaatgcagatgagaagactattaaaaaggcctatcgtaaattggcgaagaaataccatccagatattaatcctggggatagtaatgccgaagcaaaatttaaggaagtgacagaagcgtatgaagttttaagtgatccagagaaaaagaaactctatgatcgttttggtcatgccgcctttgatggaacgggaaatgcacagtctggcccgtatggtaacgatggaggttttggaggttttagtaacttcgggggaagcggaggttttcgcggaggcacataccgctcgaataacggcaatggttatcaggagtttcattttgaaggcggtgatatgggagatatctttgaaaacttttttggcggaggctttaaaaaatctggtttcagaggcggctctggtcaaaatggaaactttaataatggctttcacggcaatttccggcaaaatggaggatttggaaatcggcaatcttatcaaacaaaaggaaatgatattcatgcagatatacaggtaaactttgatgcagccgcatttggaaaaaaagaaacaatccacttaaaagatgagaatggcaaagtacaggcattagaagttaatattccggcaggaatagaaacgggacagagtatcagattaaaaggcaagggaactcccggctataatggtggaactgccggtgatttattcttgaaagtaaccgtttcggaaaagccaggttttaagagagacggtcaggatatttttaacacagtaactatcccatttatcacagccgttcttggcggagatgtcaccgtaccgaccatttatggtaatgtccgctgtagcataaaaccgggaacacaatccggaagtaaattaagactccgcggaaagggtatcgtctccatgaagaattcttctgtacatggtgaccagtatacgacgatagaggtgcaggttccgaagaatctgtctccaaaagcaaaacagaagttgagggaatttgctgcggaactgtagcaggcgaagttgacgaaacatagcaggccaatatgtttctgacggtggctactgaagtaacgccagaaattcctgttgggaatttggagattctccagaacattgtgaattttcaaaatacatttttcctatgacagagtacaaaaaagataaggctacaatttattttctcaatttttttcactgatttgcagaatagaataaacctattcttcgaataccatgttatagaattgctatatttttcgtaaaaccgcaaccttctggcgaatccccaaatacttgaacatgaattctgatttaacttcagcagccaaagacagccttttacgaatttccaaattctttaataataaattccatttttttcttccacatcccaagcacagccctctgagaatgaaagaatccttatttgtggcctcggagcaagtgttggatacgagcgagtagagcgagtattcaacacgccgcgactaaagtcacaaataaggattctttcattctcagagggcgtttgtttggcgtctatcttgcctgcggcaaatcagatttcaacttcttctccgctgttgccagcatcaatttaattcggtttacctggtttacttcgcttgctcctggatcgtagtcaattgcgacgatattagattccggatacttacggcgcagttccttgataacacccttacctacaacgtggtttggcaggcaggcaaatggctgtgtgcaaacaatatttggggcgccctgtttgataagttcaaccatttcaccagttaagaaccatccctcaccggtctggttaccgagggatacgattggttttgcgtactcggcaagttcctcaatgtgaggtggtgcagtgaaacgatcgcttctttctaattcttttcgcaggaagcctcggtaagcttccagtgcagagattgccatattacataacttagcagcttttgtagattttccgagatattctgctttaaaattactattgtagaaggagtagaacataaagtctaataaatctggcattactgcctctgccccctcttcttctaaaagttctaccagatggttgtttgcgtctggaaggaattttacgaggatttctccaacgataccaacacgaggtttcttctcatctgtgattggtaatctgtcaaagtcgcggataatgccgcggatatttttcttaaattctccatatcgtgctttctcaagagatttaatacaacgctttttccatacttcatgtaaatgatttgcagaaccttttactttttcgtatgggcggacgcggtagagaacacgcataaataaatctccgtaaataactccctgaagagcacgaactaaaagtgccggagtgaatttaaaaccttcattcttctcaattccctgtacgcttaaactgataactggaatctgaccgtaaccgttcttagctaatgcacggcggatgaatccgatatagtttgtcgcacgacagccaccaccagtctgggagatgataacggctgttttgttcagatcgtatttgccggaagttaaggcagtcataatctgtccaacaacgataagagatggatagcaggcatcgttatttacatattttaatccagtatctactgcctgtttccccatttccggcaaaatctctacgttatagccacagtgacggaaggcaggggtgagcaggtcgaaatgaattggggacatctgaggaatcagaatggtgtagtcctttttcatttcttttgtaaattctactttttcgatatttgccggaaccggatgtggctcaatgtgcttacggtttctgatctttacggcagcaatcagagaacggatacggattctggcagcacctaagttatttacctcatcaatcttaaggacggtataaatacgtccggaattcgtcataatatcatttacctggtcggtagttaccgcatcaagaccacagccaaaggagttaagctgaatgacttctaactgcttgttcttctttgcgtagtttgcggcagcgtacagacgggaatgatacatccactggtcagaaacgattaatggacgctcaacatgacctaagtgacagatggaatcttcacttaatacggcgatgccaaaagagttaatcagttcaggaataccgtggttaatctctgggtcgatatggtaagggcgaccacaaagaacaatacccatctttccagtttctgcgagataagcaagtgtttcttcgccctttgcctgtacatcttttcttacctgtgcagcttctttataagcttcatctacggcatggtcaatctcttcttttgtcacatcgaaatgtttagataactcgtcataaagacgtaccttcaaggcatctgcattatcgagtgctaagaatgggttcataaaaaggacattcggatcacggagctcttccatgttgtttttaatattttctgcataagatgttacgatcgggcagttgtaatggttgttggcaccttccatctggtcttcctcataaggaacacaaggatagaaaatggtgttgatacccttctttaaaagccacattacatgtccgtgtgcaatctttgcaggataacattcggattcacttggaatggactcaataccaagttcgtaaatctttcgggaagactttggagaaagcaatacccggaaagaaaggtttgtaaagaatgtataccagaatggatagttctcatacatattcagtactcgtggaataccgataacaccacgttttgcctcgtctggttttaatgctttatatccaaaaattcgtttatatttatattcgtaaaggtttggtacatgctcatgattcttttcaaggccaagaccacgttcacaacggttaccagaaataaactgacggtcattgttaaacttattaatggtaaggatacagtggttgttacatccctgacagcggctcatggaagtgctgtattccaagttgataatctcatcgatggagagcatctgtgtatctccagtttcttcctcacgctctcttgcaattaaggctgcaccgaaagcacccatgataccggcaatatctggacgaacggcgtgacagccggaaatacgttcaaagcttcgaagtaccgcatcattatagaatgtaccaccctgaacaacgatttttttaccaagctgtttggggtcggttaacttaataacttttaataaggcattacggataacggaataagcaaggccagcagaaatatcaccaacgctggcgccttctttttgtgcctgttttaccttggagttcataaatacagtgcagcgggaacctaagtcgattggagatggggcaaacagcgcaacctttgcaaaatcagctacagaatagttcagagattttgcgaaagtttcgatgaaagaaccacatccagaagaacaggcctcatttaaaagtacgttatctacagcgtggttacgaatcttgatacatttcatatcttgtccgccgatatctaaaatacagtctacatctggctcgaagaaagcggcagcatagtaatgtgccattgtctctacttcgccgtggtcaagctgcagtgcagccttaattaatgcttcaccgtaaccagtagaacaggaaccggaaatcttcgcagcaggaggaagtaactcctttaactctttcatagcacgaattgttgtatttaacggacttccgttattattatcgtagaaacggtataagagggaaccatcttctccaactaaagcaagctttgttgtcgtagatccggcatcaataccgagatagcatttgccactgtaggtagctaagtctgcctttttcaccttgaattggttgtgctcttcgataaattcatcatattctttttcgtctttaaaaagaggctccatacgttctacttctacagcaagctgaatgtcggattcaaactcttttaagagatcatctaatgtgaaggaacattcttcttttgcgtttaatgcggcaccttttgctgcaaaaagatgagagtatggagggtcgataatatgttcttcgtccagatttaaagtacggataaatgcattctttaattctggcataaagtgaagaggaccaccaaggaaagcgacatatcccttgattggtttaccacaggcaagaccactgattgtctggtttactacagcctggaagatagaagcagcaagattttcttttgttgccccctcattgattaatggctgaatatcagactttgcgaaaacaccgcaacgagcggcgattggatagagggtatcgtaatcacgggcatattcattaagaccggttgcatctgtctgtaaaagacttgccatctggtcgatgaaagaaccagtaccaccggcacatacaccgttcatacgctgctcaattccgttattaaaataaataatcttggcgtcttcaccgccaagttcgattgctacgtctgtttttggttcataatcctgtaaggcattcgccacacaaactacttcctgacagaatggaatatgtaagtattctgagattgccatcccaccggaaccagttacggttggatggattgtgagattgcccagcttttctctcgcctcagataataaggtctgtaaagttcctttaatatttgcaaaatgtcgtttgtaatcggaaaaaaggatatcatggctctcattgataactgttaccttaacggtagtagaaccaatatcaatacctaatgcgtgtttcatgattaattaatcatctcctttagtaaaatgtgtattcatgttgtgtattaaaataaggtaatctaatgttcagaatacatttataacaccgtccgcgatacacttcgcttgccgatgccaccgtatcgtcttgttcagtcactttgttgatgaaaaagcattctgcgttatttgacagaaaggcaatgagacagacactatggctctgaatcactatatatagataaatttctcaatatccaaaccattataaacgagttgaacgtaaaatacaacaaatttcgaaaaaaagatataatgaatggaaaatgtttacaaaaagcaaaagaagaggggagtagttgtataaggagtttttcacgataaagtacctttttctctgactgtcatattttataattgaggaagaaaaaggaagagcatctatgagtgaaaaagtttatgtaaacatatgtgacaccaaaaaatgccccggcccggtgtatgcagtaaagacaggagatacgctgtatagcattgcacaaaggcatcattgccgggtaagaacacttcttgatctaaacccttttgtagatatatataatttgcagccgggtgaggaaatctgtgtaccagactgcaggggacaggggaaagtagatttccggccttatgtagtaaaagaaggggatacattaaaaattatcctgaaaaatgtttcaatgacctttgaagaattagcaaaggtaaaccgtattttgtataatcttactgtaccagcgggaacgattctgctcgttcctgcaaaaaaagaataaatgaaaaagaaaagcagttaaaaaatagtaaaaaaatcacagaaatgcgtttgacaaagtattagatatttcttataataaatttaaacggtttcagttatgtaagagtccgcgaaacggactctttctttcgttttgccaagatagagaagatgcagactgagatacgataaactgttgaaagagggaagtctcatgataagaatttttaaaacgaccgattcagggattcgcaaagttgcagtggcagaggaaggatgctggatagcccttaccaatcctacggcagaagaactaagtaccacagcagaccagtttaacattgatgttgacgatttaaaaagccccttggatgaggaggaacgttcccgtatacaggtggaggaaaattacacattaattatcctggatattccaacaatcgaagagcgtaagggaagagaatacttctatacgataccgtttggaattatctttactgataagtatatatttaccgtctgtcttgtagactcaccggtactgaccgtatttatggatggaagagtgagggatttttatacgtataagagaactcgtttcatctaccagatgttataccgcaatgcgacgatgtttctgcagtatctgaagattattgacaagaagagtgatgaagtggagaagaagcttcacatttctcagagaaatcaggaattgattgaaatgcttgatttagagaagagtcttgtatattttacaacttctctgcgaggcaacgaggttgttcttgagaaactgatgcgtaatacatccattccacgttatgaagatgacgaggagttacttgaagatgttatcatcgagaataagcaggcgattgagatggcgaagatttatagtgatattttaagtggaacaatggatgcctttgcttctgttatatcgaataacttaaatattgcgatgaagtttttgtcagttattaccattgtgcttactgtaccaacgattgttacaagtgcgcttggtatgaacgtagcaggaattccatttgcgaataatccatatggattttggattgttgtaggaatctctttattactgactctgattgccggagcaatcattgccaagaataaacattttaaataattgaatatgtatgagacagccgggatttccggctgttcatttataaacaaaaatattttattaagaatgtacgcttgggatttttactgcacttgtttttgcagaaggtttcttgtcagtacattgaaagttaaaggaggagtgccatgaactggctagataagctggaacgtaaatttggaagatatgcgatacgaaatctgccgctgtatatcgttatgctgtatgcgataggagcggtacttaatattttgacaaagggttcttattactattatgtcgcattaaacccgtatatgatacttcatggacagatttggagactgcttggtttccttattgtgccaccgaatgcaagtctcatttttattatttttgtactgatgttttactattcgattggagaatctttagtacaggtatggggagcatttcgctttaatatgtatatccttataggagttcttgcgacaattgtggcatcatttattgtatattttatttatccatcaacaatgattttcatggatactttttatttgaacttatccatgtttttagcctacgccacgatattcccggagatgcgggtatatctttatggtattcttccgctgaaagtaaagtggatggcgtggtttgatgtggcgcttttagtttggcagtttgtcgttggaggacttggagcaagaattgctattgtagtaagtttactgaactttctgctgttttacttctcatcaaggaattataaaaaggtttctccaaaagagattcacagaaagagagcataccggaaggcatcatctgtggcttcaaataaaccatatcgtcataagtgtgcagtctgtggtaagacagaattagatgacccaaatttagaattccgttactgctcaaagtgtaatggaaattatgaatattgcaatgaacatttatttacacatacgcatgtaaaataaagcaatattaaaagagttatattctttcaaataaatctgaaaaattaatggatagaataaagatataatataagttgcaaataaatcatgacaggaggcggtcttttgttgacaatatcagaacatataatgattgggaagacgatttcccacgatgcgaaggctatattgcggggagtccgccatccttttatatggaagaaaggactttggtatggtattacgacttcctgtgggaaagatgtgatcatgtatattctttcttcacgagagatgagacagaagttttatcagaacaatgatttaaagctgttgggacttgcaggttctatgaaagaggcttatgaaatcgtgttaaaacttgtgcagatgggatataatagtgattgtatctatgagatgaatgattatctggagaagttttaaaacaggaggagaaatgtgctgtatgtattattattactattaaaaatacttggaatactgctcctgttatttatcggacttgttttgcttgttctgctaacgccgattcagtattcttttgaactcgaaaaggaggaacagaagggaccaaagtttatggtaagagttacctggctgttctggcttttttattttaagaccagttacatagagaaggtctttgattaccggatacgtatactggggtatcagattgccgggaatcagccggaatttcttgaaaaacagaaagaacggcaaaaaaagaagtctcaaaaggaaaaagcaaaagaagaacgtaaaacagcagagacactggcagagggaaagagtcgaagcatagattctgtttctaaacagaaagcggaaaaggcagtccctaaagagaaatcctcagatgtgtcagaaggcagagaaaaaacaaaagagaaagactctggagatgataaaaatagtaaagataagaaaaagaataaagaaagaaagcaaaaagatggaaagaaaccaaagaaagagtcttctttaaagaaaataaaaagcaaaataaaaagcttaaaagaaacaaaggttaatttagataaaatgccgtggcgggaatggttagagctgggaaaggacgttcttattcgctttctaaagcatgctcttccgggaaagctagaaggaaacattgcatttggaactggtaatccggaatatacaggatatattacaggtattgcggctgttttttatccgaagtatggagaacatttttctttatatccggattttgaaagaaagatgttcgaggccaagtgcaggggaagaggaagaatccggctgggatatatgcttgttctggctgtttctatattaaaagagaaaagtgtaagaacaatgattaaaaacatcattttaggttaaacaggagggcgtacaatggataaacaaaactttgatacaacagtgaattctttatttagtggaatggaccacgtattatcttcaaagacagttgttggagaaccacaggttattggagatacgattattctgccacttgttgacatttcctttggaatgggagcaggtgcctttaataaagaaaagggaagcagtgcaggcggtggaatcggaggtaaaatgtccccaagtgctattttagttattcataacggacagacaaagcttgtcaatatcagagatcaggatgccgttaccaaagtacttgatatggttccagatgccgtaaataaagttgtttctattattaagggagaggacgcagaggacaaagttgacccggaagtagaatctgcggtgaataaagcagcacaggcagaggcttctgttgtagatgtagatggcgcaggaatttaaaaggtattcggtattcagttaacgtgagattaccacgttactttcgtgcaggaaaaatcttccacgaagtgtaatgcatatcgtatagaaagcggtttttaaacacactttgggttgccttagatcaatcaaataaaaaaagtgaagatttttaaaagttttccttgcaatttgttttgatttctgatagtatagactcgttgtaagtctgtcagacttaagtatattcgcgaggaggtgctatcatggcaagatgcgctatttgtgacaaaggtgctcatttcggtatcaaagtgagtcattcacatagaagatcaaacaaaatgtggaaatccaacattaagtctgtaagagtgaaagtgaacggagcttctaagaaaatgtatgtttgtacttcttgtttaagatcaggtaaagtagaacgtgcgtagttttactgtcactgaggataagagaagactctaatctttgtccttacaggaatgtatgcagatatgagttaagagggaatcagtgattccctcttttttcttttctgttaaaatcggtcacaaaacagcagatatccaagcaggatgctgatgaccagaataatgaactttactgcaaagccggtgagaaagcagctcaggaacagaccaaaggaaaagcaaaaaagagcgaatccgcataattttttcataaaatctccccaatatgttccttataataatatatgggaagatacttcttttgtttcaggagaaagcacttaaaatggaagaattttatgtttgtggttccaatttcaccgaaaagaggttatactatagaaaacgataataaaacggagggatagtatatgaagggacaaatgcacaccgatttaggtcaggttattatagatgaagaggttattgcaacttatgccggaattaacgcgattgagtgttttggtatcgttggaatggcatctgtgaatatgaaagatggttttgcccagcttttaaagagagacaatgtaagcaagggcgttcatatcaagataaatgataacaagatttatatagattttcatattattgtagtatatggtgtctccatagctacagttacagagaatttaatccagaatgtaaagtaccgcgtggagaagtttaccggtatgagtgtagagaaaattaatatttatgtagagggagtccgtatcgtagattagaacgtgtttgaaaaatgctttctgcaaattggggcgtgcaggttgttggaatgatttttcaaacacgctctaagataacgctttagaagggattcctttttatagaataaaagaacaagataactactatgaattatagataaaacaggtaaataaggaggaaatgttgtgaacagtcacaccatagacgcaaaaacttttcagaaattgtttttagccggtgcaaaccgtattaattccagaaaagattatatcaacgaactgaatgtatttccggttcccgatggagataccggaacaaatatgtccctgacaattttagcagcagctaaggaagttggagcagttgctgaacctacaatggctacaatatgtaaagctatcagcaatggttctcttcgtggagcccgtggtaactctggtgtaatcctttcccagttattccgaggattcacaaaggcagtttccaaagcagattctcttggtaaggatgagattacagccggatttacaagagcagtagagacagcgtataaggcagttatgaagccaaaagaaggaactatccttacggttgcaaaaggaatggcagataaggcagaagagttagtcgatgaggatatggatgttatcgcattctgcgaggcaatcgttgcctacggctacgaagtcctttctaagacaccagatatgcttccggtattaaaagaggcaggtgtagtagattctggcggacagggtcttatggaagtgttacagggaatcgttgatgctcttaccggcaaggtaacagacattgaagttccggcagaggcagcgtctatgtcatctgcagtaatcagtgcaccaaaagcagatatttctacagcagatatcaaatttggctactgtacagaatttattattttgttagataagccgctcacaaaagaagatgagaagggattaaagaagttcttcctttctataggtgattctttagtattagttgcggatgaagagatttgtaaagtacatgtacacacaaatcatccaggagaagcctttgaaaaggccttaacatttggtgcgctttctaatatgaagattgacaatatgcgcttagagcatcaggagaagctcatcaaagatgcagagaatgaggcagcccgtcagagacagcaggaagcagaagaagagaaacttgccgctaaagaagcagctgcagaaaaaccagccaaagaagttggatttattgcagtatctgttggtgagggacttaccgatattttcaaaggtcttggtgtagattaccttattgaaggcggccagacgatgaatcctagcacagaggatatgcttaacgcaatcgagcaggtcaatgcaaagaatatctttatcctgccaaataataagaatattattcttgcagcagagcaggccagagatttaacagaagataagaagattatcgttcttccaacaaagacaattccacagggaatatccgcaatgattggatatatgccagaagcaggtgtggatgagaacgaagagaatatgaaagaggcttatcaggatattgcaagcggtcaggttacttacgcggtacgagacacagtaattgatggaaaggaaattcataatggagacatcatgggaatcaatgatgatggaatcgctgcagtaggaaagaatcttactgagacaacattagaattactttctacaatggcagatgaagattcggaacttatttgcctttactatggagccgatgtaaccaaagatgatgcagatacactttccgatgcaattgaggataagttcccagaatgcgaagtagaggtcaactttggcggacagccaatctattactatatgatttctgtcgagtaagataaatgaaataatgatataatgaaaaaagagggaataaattactcctttgtggcagcaattccgtgtattgacatggaatcgctgctattttcatataagagtgttttgattaagataaaataatattaccacatgatgcatgtggaggaaggagaatctcagttgggaataccagtaagggaaattaaaggaattggagaaaagacggaaaagttacttgcaaagcttgacatagagaccgtagatcagttggtgcatcactatcctcgttgttacacgacttatccagagccaatttccatatcagagataaagacaggacaaagatgttcgattgaggcagaaatcgcttccccgattcatctaaagactgttcggaagttaaaactttgtaccgggcttatcgcagatgtcagcggacagctttttgtgcgctggtttaatatgccgtatcttcgaaatacattaaaacagggagaacagtggatttttacaggaaccccgatttataaagatggacgtcttatgttagaacagccggagtactgtaagagggaaaagtatttgcagttaatggaaacatttcagccgatttaccctctcacaacaggattgtcgaataagacagtacaaaaagcacaggcagctgcatttgaaatgtacagagaagaagagtatcttccggaaaccgttcgaaattattatgatttagaaccagtgaatacagcacttagagaagtacattttcctacagggaccgaacatttgatggaggcgaaaaagcgaatcatttttgatgaatttttccgttttttcagtgcgttagaacttgtcaaagacagggaggaacaagcactcaatcactatattattccaatggaagaacccgtaaagaggtttgtagaaaatttaccgtatcctcttacaggggcacaaaaaaaggtgttaaatgaaattcgccaggacttttccgatacaatggcaatgaaccgccttttacagggagacgttggttcgggaaagacgattgtagcaatgacagcgatgtatgctgctgttcttgccggttaccaagcggcgttgatggctccgacagaggtacttgcagaacagcattaccagaactttgtgaaactcctttccccacttgggattaccgttgccctgcttaccggttccacaaaagcaaaggaaaaaagagagataaaggcagcctgtgcctctggtgagattcaaattttaattggaacgcatgcagtgatacaggacgatgtagcttttgacaatcttgcatttattgttaccgatgagcagcatcgttttggagtaaaacaaagagatgcctttatgaaaaaagggaaagacccccatgttcttgtaatgagtgcgacgccgattccacgtacactgggaattattttgtacagagatttagatgttagcattatgaatgaaatgccggcttccagactgccgattaaaaattctgttgtgggaacttcctatcgtccggctgcatgggaatttataagaaagcaggtagcacttggacatcaggcatatgtgatctgtccgatgattgaggaaaatgaaaaaatggatttggaaaatgtggaagagtatgcaagaatgctttcgcaggcattaccgccttctattaccgttgaagctttaaatggacatatgcgcccggcagaaaagaatgatattatggaacgcttttcgaagaatgaaattcagattttagtttctactaccgttgtagaagtcggtattgatgttccaaatgcaaccgttatgctcatagagaatgcggaacggtttggccttgctcagctccatcagctccgcggacgtgttggaagaggaaaagcacagtcatactgtgtctttatttctggttcagaaaaagaagaagcgatggaacgtctttccattatcggacattctaatgatggatttgagattgccaatgaagatttaaaacttcgtggtccgggagagttttttggtgtaaaacaaagtggaacgatgaattttgcacttggcgatatttactcgaatgcagatattttaaaaatggcttctgaggcagtggattacttaaagaaagaaggatataatttccagaaattgcatcagtattctctggagaagaatttgaattttgcaaaaaatatttaaaaaccgaatggaaattgctatagtaagagaaaacaataagagaaattttatgaacgatagaaggagattactatatgaagagaaaaccgtatttaaattacactcgccttcctatggaaaacgcatataatgtacgggaattaggaggctatgcaacaaaaaaagggtcggttacaatacatcatcaatttctccgcagtgagaatcttaccgatattacagaagaagataaaacgtttcttatagaatacggcctttctggtattattgatttaagaagcagggaagaagcattaatctatccgaatccttttcggggaaataacgcagtaaaatacataaactgtccgctgatcacagatggaatcctggatttaagagcggtaaaagaggtaggatttgacccgggagagttttatgtgaagctggtagaatacaaagaaatgttgtataagattttccattttattttagacaatattgatgggtgcctgttgtttcactgccaggctggaaaagacagaacaggagtccttgctatgattcttatgggacttgcaggggtttctaaggaggatattgtggcgaactatgaagtaacacatacctatttaaaagagaatgtaaaactacgtttagaagatggccttgaggaattagagttttcgaagccacagtggatagaaaaagcgtatgatcatattatagagcattatggctcttttaaagtatatcttatggcagtaggacttacgaaaaaagagattaagaaaataaagggaaagctggcaggctgatattaaaaaactggttttagtaactggaaaagaggctatgataacaggaattttgctttttaaacacagagtattttctaagaaaggaagtgccttgacaaaaataggatatagtatacaataaatataattatacaagaaaaaggatggacgaaagatattatgagagttatcgcaggttcagcacgtcatttaaaattaaagacgattgagggaatgggaacacggccgacaacggaccgaattaaggaaacgttatttaatatgctgtctttttatgtggaggagagccggtttcttgatttgttcagcggaagcggcggcattggaattgaagcattaagcagaggggcatcacaggcggtctttgtggaacaaaacagaaaggcagctgcctgtattgaggagaatcttaatcatacgcaccttagagagaaggcagtagtgatgtctaaagatgttatgacagcactccgcattttagaagataaaaaacaagcatttgattacatatttatggacccgccatatggaaagcttttggaaaaagaagctgttttatatttagatggttcggtgctttgcgatgagaacacaacaattattattgagtcagatcttgatacagaattctcctgggttatggacaccggatttaccattacaaaagaaaagatttataagacgaataagcacactttccttcagaaaaagtaaagaaaagaatattacgaaagtagaggaacagacgaaattatggcaacagcagtttacccgggaagttttgacccgattactctaggacatttagatattataaaacgtaccgcagcagtttttgacaaagtgattataggtgtattgattaataaagcgaagaaaccacttttttctatagaagaaagagtggaacttattaaggaagtgacgaagaatattccgaatgtggaaattgtatcttttaatggacttcttattgaatttagtgataaaatgaaagcagatgtcattgtcagaggaatccgggcagtatcagactttgaatatgaattgatgatggcgcagacaaataaacagttaaacccgaacatagaaacgatgttttttgctaccagcgcagaatattcttttgtaagttccagtatgataagagaacttgccgcatttgatggggatattacaccgtttgtaccagaagaagtcagtaaaagggtctatgagaagtataagcagagctaactgcggtatgggaggaaaagaatggcaaatatgagtatcgaagaattgattgaagaaatagaagtatatgtggataattgtaaaactgccggagtcttaagcagcggaagtatgattaagataaaccgggaggaactgttagcaatgcttgatgaggtgcgcacccgcctgccaaaagaactggcagaaagccgccagattataaaatccaaggaatccatcattgcggatgcaaaggcccgtgccgagcgtatcgtaaaagatgcagccaaagaggctggtgtgatgattgatgataatgagattgttgcactggcaaatatgcgtgcagactccatcgtaaaagatgcacagaaagctgctgatgagctgaatggaaaggcgagagaaactgcaagagaggtacagacaggcgctctgcagtatacacagaatatgttagaaggccttgaatatatgtacagtacaattattaaagaagaaaaagaatactttaattccgtactcgaaaagttaaagtcagaacataaacagattgttgcggacaaacaggagattgacctgcagcttggagcaggcattcggacaggccggagaaaagaagattttgaaaagaaagaggaacgggcagaagagtagattatcgaacacgctctaaaagaagaaagcagttctttaggggaaaataaaaagtgtacccctttgctaaatacggcaggaaaaatagggatgagaatctgcccttattaatactgaaaatatagagacaaaaggtcagcataaaagaattaggcatagaagaaagctcacaaaagcagtccctgtctttataacaatatatctttttaaagacagatctgtagcagagagaactgtctggacctgggccatagtacataacccgccaaaagatgtagcagctgcaatgagggcatattgtatctgaggtgtgataaatggttttaaggctaataagtgaattcctgtagtgacctcaagattcgcaagcacaaaggtgaatacaggtgcctgaaaaagcggaaagcttgtaagcattcctgaaagaatggagaagatcatcatatagattccgataataaagatgatttcgagagaaggaagaaagacttcttctgataaagagagggcaggaggcttcttatttgaaagttttgtgacagactttgcagaatcttttctggcgaaagaggatgagctggcctgtcttcgctttttttgtctatgatatatagcagaaatatgtgagtctggaatcaggagtagcagatagcataacaaaacaggcaggtaaaggcaaagaagatagtatatccataatctttcctgcagatttatctgggagcggacgtaccctgctacaaacatagggcttacgaaggaggccagaggaagcagtgattctgcctgccttttgtttaagagattctgttgataataatgcgaaataaatatagcaccaacagggaagccagagcaaagtccaagcaagaagacgggaagtgaaatagcgatggtcgtgcctgcgggaacaaggcggtgtacttgcttaaagaaaagttgtggtatttcgtaccgaatccagaatttcgacaaaatgataaatggcaagagaagcggaagtacacaggagacccatacaaacagtccttcttttgcgtactttaatacgagagaatactgtaaaagcataagaataaaggataagcagcagagtacttgtgctaaacgaaaaataagttttttcaaatcagatctcccagcagttcatttaataaaatatatgcgaaatatatgaaaatatttcttgacaaagaaaaagtaactgtgtataataccaagagtatgagaaaagagaggttgcgatattatgaagataaatatatcggaaatcttatctaatccatctgttatcaagaattttaaagttgagcctgattttgagaagctcaagcttcgaagaggcagttatccggtatcctataaggagccttttcttttgactgtttccaaagcagaagataaacttcatgttacaggtgagacgacgattcgattgataataccatgtgatcgatgtttggaggatgtggagaatacattccatatcacgattgatcgcagtgttaatcccaatacagagtcagatggcattgaagacgtggatgaattaagtttcatagacggatatatgttggatgtagacaagctcatcatggatgagattgtggttgcactccctacaaaggttctttgtaaggaagattgtaaaggattgtgcagcatctgcggtaccaacttaaacaatcacacatgtgattgtcacaaggagagccttgacccgcggatggcggctattcaggatatcttccgtgactttaatcaataagatattaaagtattgaatactgcataagtaatatatcccgaacgtcacaaaagaagtaattacaagaggaggtgtgaccatgtcaatttgtccaaagaataaatcttctaaaggaagaagagaccgccgtagagcaaactggaagatgtctgctcctacattagtaaaatgtagcaaatgtggtgcattaactatgccacatagagtatgtaaagcatgcggatcttacaataaaaaagaaatcgtttctgttgactaattgttgacgaacagtaagccgggaaatggttttaaaaaggcaatattgcatgatagataggccagacattatgtctggcctattttttgtatatagattgtattcgaaaaatgctttctggtttttacaatgcatttttttagaagcaatcacaaagctgattaatttccacataaataaagaagtagttgcatgaaattataaagctgacataaaagaaagatgtacggatagcaaagggggattttaaaagtaacatttgttcttgaccttatatattgcaaaatagtaaaataaaactagaaattttacaaagtaaaagaggtaaaatactatggagcatacgaaattaacagagcttttgaataaggttgcacagggagaagtcagcgtcgaaaaggcagcgttagaattaaagacagaaccttttgaagaccttggttttgccaaacttgaccatcacagaaagattcgtcagggagcagcggaagtcatttatggtgctggtaagactccggaacagattttaaaaatcacagaagctttccgtaaaaaaggagataatgctgtcttgattacaagaatgagtcaggaagcggccgatttggttggtgccagtctccctctcagatatgatgcattaagccgaacgggtatcgtcggagaactgccagaaaaggatggcaatggaaaggtagtcattgctacaggtggaaccagcgatttgccagtggcagaagaagcagccctaacggcagaagttctcgggaatgaagtcgtaagaatctatgatgtcggcgtagcaggaattcatcgtttactggcttactctgaagatctgatgagtgcacaggttatcgttgttgttgcaggaatggaaggagcacttgccagcgtagtcggcggcctcgcagactgcccggtaatcgctgtaccgacaagtgttggttatggagcatcttttggtggtttatcagctcttttatccatgcttaactcctgtgccagcggagtcagcgttgtaaacattgataatggatttggtgcgggatatatggcaagcatgattaaccacgtatccatgaaaaatgcagagaatttgaattgagaaatgcatataaaaagataagaacataaaggagtcaacaacaatgaaaacattatatttagaatgtaacatgggagctgccggagatatgctcatggcagcactcacagaattaatgccggataaagatgcttttgtaaaagaattaaatgatttgcagattccacaggtaaacatcgagcggacaacaattgcaaaatgcggtattatgggaacacatatggtagtgactgttaatggggaagaagaaaaaagtatagatgttccaatgcacgcacatacacacagtcatgttcatgaagaacatgaacacagtcatgaaggacatacacatgcacatggacacagccatcaccataccagcatgaaagatattgagcatatcatcggacatctgaacgtaccagaaaaagtaaaagaagatgctattgccgtatataaattaatcgcagacgcagaaagccatgcacatggccgtccggtagaagaagtacattttcatgaagttggagcgatggatgccgtagcagatatcgtaggtgtatgcctggcaatttataaacttgcaccagagcagattatcgcttctcctgtccatgtaggttatggacagattcactgtgcacatggtattcttccaatcccagctccggcaactgcacacattttacagggaattcctatttatggtggaagaattgaaggagaactctgtactccaactggagcagcacttttaaaacattttgcccagtctttcggacagatgccaatgatggcagtagaacagacaggctatggtatgggaatgaaagactttaccgatgcaaactgccttcgtgcgattatcggaaacaccgtagaaggacaggagcagacaggctgtcacggagcagtgcaggaaatggattccatcatagaactttgctgtaaccttgacgatatgacaccagaaaaaatcggttttgtcacagaacttcttatggaagaaggagcctttgacgtatatacaaccaatatccagatgaagaaaaaccgtccagccgtaatgcttacctgtatgtgtgcaaaagaggatagagaaaaattcctcacacttattttaaagcacacaacgacactcggcgttcgtgaatatacctgtaaacgctatggcctgaaaagagaaattagagaagtagaaactatttacggaaccgttcgtgtaaaagcagcctccggttatggtattacaaaagaaaaaccagagtatgaggacatggcacgaatcgcaaaagagaaaaagatttctctggcggaaattgaaaaagaggtttataagaatttaaaatagacacttattaatctaaaaatagaattttagtccagctctctttaattaggaagctgggctttttgtatcttcatttcaagaatgcctagcattcttctgcgagatgcgcgtcatgcaatgcatgatatacttatttcacttatctatttgagaaggactaaaaggttctgacaacataaatattaaaagtttcttcaggaaagtactcggcaattaaattacgatattaagtgtcgtaatctatgttaaaataaagaacgatattttattttaatactttgtaattgacagagtgtcaaaatagctgtaaagtatacttgtaatgagaaaatatttcatttcagactaaatattatgagaaagggattgcgaacatggaaaaatcaaaagtttattttaccgacttcagggcaaagttaggagagggacttccactcaaattaaagagacttctgaagaaggccggaatctcagaaattgatatggagaataagtttgtagcaattaagatgcattttggtgagctcggcaatgtaagttttcttcgtccaaactatgcaaaagcagttgcggatgttataaaagaattaggtggtaaaccatttttaacagattgtaatacgctatatcctggaagccgtaagaatgctttagagcatttacagtgtgcctgggagaatggatttactgcaatgactgtcggatgtcctattttaattggagatggattaaaagggacagatgatattgaagtacctgtagaaggtgtagaatacataaagagtgccaaaattggccgtgcgattatggatgcagatatttttatcagtttaagccattttaaagggcatgagacgacaggatttggtggtgcgattaagaacatcggtatgggatgcggttctcgtgctggtaagaaagagcagcatacaaatggtcagccaacgattcacgaagatatgtgtcgaggatgccgccgctgtatgagagagtgcgccaataatggtctggtctttgatgaagagaccaagaagatgcacattgatggagctaactgtgttggttgtggaagatgtatcggtgcctgtaattttgatgctattgaatttgagaactgggcagcaacaaaggacttaaactgcagaatggcagaatatacgaaagcagtagtagatggaagaccaaactttcatatttctttagttgttgatgtatctccaaactgtgattgccatgcagagaatgatgcaccaatcctgccgaatatcggtatgtttgcatcctttgatccattagcattagaccaggcctgtgtagatgcctgtttgaagatgcagccactgccaaacagccagctttctgaaaatatgcataaagaaggcttttgcgatcatcacgatcatttcgaaaattccactccggaatctgaatataaaacatgcttagaacatgcagaaaagattggcttaggaagcagagaatacgagcttattgtgatgaagtagtaattttatcttgcttttttctgacaataagtgtatattaaatacaattgaacaacaggggagcttgtattacaggctgagaggaaggtatgaccttcgacccattaacctgatttggataatgccaacgtagggaagcataaaagttttgtatagtttacgggaagttaccgaatcggtggtttcctgtttttttatgtaattcattttatataatcggaagtcacttttgaatctcctattatgtgaaaacccttcaggcagaattcttttcttagtctacaggaggtgaaagtgtggtaagaatcaatggacaggattgtgaaaaaacaggaatttctgtttcagattacctggaacaggaaaattataatgtgaaacatattgttgtggaatataatctggagattattccaaaagaacggtatgcacagacaattttaaaagatggtgatgaggtagaaatcgtaagcttcatgggcggcggcagcaaataagtgtataccgccaaaaagcttataagaaggcagtaatgcatttttatgaaatgatagcaaatgtatttatgtcgaaagtttatggttttacaaagtaattacttaactgcgagaaatatgtgagaaagaagggcgttttattatgaagacaaaagataaattagtgattggtggacatgagtttgattcccgttttattttaggttctggaaagtattccatgaagttaatcgaagcggctgtaagagatgctggtgcgcaaattattacgttagcagtgcgcagagccaacacaaaagaccatgaaaatattttagattatattccagagggtgttactcttttaccaaatacttccggagcgagaaatgcacaggaggcggtaagaatcgcacgtttggcaagagaacttggctgtggaaactttgtaaaggtagagattatgcgtgacagcaagtatcttcttccagataaccaggaaacgattaaggcaacagaaattcttgcaaaagaaggatttgttgttatgccatatatgtacccagacttaaatgctgccagagatttagtgaatgcgggagcagcctgtgttatgccgcttgcttctccaattggctctaacaaagggcttgccacaaaggaatttatccagattttaattgatgagattgatcttccgattattgtagatgccggtattggtaagccatcacaagcttgtgaggcgatggaaatgggagcggctgcgattatggcgaatactgctttggcaactgccggtgatcttccaatgatggctgcggcattccgtcaggcaattgaggcaggaagaaaggcatatttatctggtcttggacgtgtgcttacaagaggagcatcggcttctgacccactgacaggatttttgcattaaatgataacttgtgaattatctcattgatatttagtcagataacctatctgttttttcatcaaactgtgttatttatctgaaagtcaatgggatagcaaaccagagagtgtttgaaaaatcattcctgcaaatcaaattgtagtgaacatcttgcaggaaacatttttaaacacactctggcaagtttgtagcaatatagaaaaatcagctttgtagaaaaggttttttaggattttagtaattataaaaatgtgaaaagatttactggaaaagaggtagcaaaatggaaaatcagtttttaattgattcagaatatttatcagccgaagctctggagaaaaagcatcgtttggaaacagacccttcttcaagaaaaagtcatatggaatatatgccaggaatggaacagattacatcagatgttatggaaaaagtcatgagtcagatgaactcttatgattatgaaaaatacacggcaaaagatgtaaaagcagcattagaacatgaaacttgttctatcgaagattttaaagcgttattatctcctgcggctgcaccatttttagagcagatggcacagaaagcgaaaatagagacaagtaagcatttcggaaatacagtatatttgtttacaccgctttatattgcaaactattgtgaaaattattgcgtgtactgtggatttaactgttataaccatattaatcgtatgcagcttaatatggaacagattgcccatgagatgaaagtaattgctgattctggtatggaagaaatcttgattcttactggagaaagccgggcaaaaagtgatgtaaaatacattggtgaggcatgtaaacttgcaagaaagtatttccgcatggtcggtcttgaaatctatccggtaaataccaacgaatatcgttatctgcatgaatgcggagcagattatgtcactgtatttcaggaaacctatgactccgataaatacgaaactttgcatctgatgggacataaacgagtatggccataccgttttgaggcacaggaacgtgctcttatggcaggtatgagaggagcgggtttttctgcacttcttggattatctgattttagaaaagatgcgttagcaagcgcacttcatgtttactatttacagagaaaatacccacaggcagaactttccctgtcctgtccaagacttcgcccaatcatcaataacgataaaattaatcctttagacgttggtgaaaaacagctttgccaggtattatgtgcttatcgcatcttccttccgtttgttggcattaccgtttcctcaagagaaagcgaaatcttccgaaacggcattgtaaaaatcgctgccaccaaagtttccgctggtgtctctactggaatcggtgatcacgaaagcaaatacactggaaaggaggaagacggcgagcagggtgatgaacaatttgagatcaatgacggaagaagcttccagaaaatgtatgaagatatttcggaagaaggcctgcagccagtcttaaatgattatctttatgtgtaagcgaagaaatcaaaattccaccaaagatctgaagcaacagcttataaaaaatggaacctatcaaaacagagactatcaaggtaaaaactttgaaaagaaaaatactacaggaggagagttcaattctatattaaaaaattctgtattggaaaaatcagatatcctgtgtattacaaatcggaaactttgtaaagatgactttttaaaaagaatccaaattatcgcagcagcgcaacccaaagcgatagtattaagagaaaaagatttatcagaagaagcatatacaatattagcagaaaaagtaatgcatatttgcgagaagtatagcgtgccatgtatcctccacagttttgcaaaagcagcaatggcccttaatgtaaaagcaatccatatgcctctgccacttcttcggaaaatgactccacaagaaaaaaatcattttgaaataattggtgcctcctgccactctttagaggaggcaaaagaggcagaaagacttggatgtacttacattactgccgggcatatctttcttacagattgtaaaaagggactaccgggaagaggtcttacatttttacaaaatatttgtgaaaatgtatctattccggtgtatgctattggcggaatttccaatgaaaacataaatgacgttagacaaacaggagcagcaggggcatgtataatgagtggctttatgaaatgtaataatatagcggaaattatataaaatttatgtagaagtgccatagatttctatgcgtatgctgtaaattttctttacgaaaagaaggcggatattatgtgaattttttatgcgataggttcttccttttttgcaggtatcacagcaatccttgcaaagtgtggaattcggaagacaaactcaaatgtggccacagcaatccgaacaatagttgttcttatatttgcgtggctgatggtgttcgttacaggtgcagaggcaggcatcagtaatattagtagtcgtacattgttattccttgtattatctggattggccacaggagcctcatggttgtgctatttccatgctctgcaaaaaggagatgttaataaagttgttccgattgataaatccagtacgattttaacaattttattagcactcatctttttacaggaagggcttagccttggaaaaggtgtcggtattgttttgatcggtgttggaacaatgctgatgattacaagaaaaggaatggcaaatcaggagaaaagttccgatggaagctggtttatttacgcagtcttttccgcagtatttgccagtcttaccgcaatacttggaaaggcaggtatcgaaggagttgattctaatcttggtacagccattcgtacaactgttgtccttgtcatggcgtggtttatggtttttgtgaccggagaacaaaagaaagtacggactgtcgagaaaatagaactactctttatctgtctgtcaggacttgcaaccggagcttcctggctatgctattaccgtgcattacaagaaggaccggcaagtgttgttgttccgattgacaaattaagcatgcttataacaattgcattttcttacatcgtatttcatgagaagcttactaaaaaagcagcttttggtgttgtacttattactgcaggaacaatacttctggcaatgatgtaaataggaatttgccggggtgagtaacagacgaagtctgagaatcaaatcacaaatatagatggtttgattctcggacttttgtttcttggctacccgagcaaattagtggaaagattagtggaagaagtcaggagagatagaagtaattcggaaatttaaatctttcaggattgatacaaaacctaaaaaaaatcaaattttcagcgtactacaacaataattcgagtcaatctttcaaaaaacaactccgcagaaagccaaaaccttctggcgattccccaaatcacttcaacaataaatagcaattttccccccacagccaaagcacagctcccgaagagagtctaacccctatatttgtggcctcggagcaaggtttggatgcgagcacttaaagagagcattcaaaccgccgcgactaaagtcacaaatataggggttagactctcttcgggggcgtttctttggctgtggagaggaaattcctatttagttgctttttccgacaaaaaatgttaatatacatgagacaaaatataaatttttctattatttatgcaggatttttcatataagatgcaaattttcgatagcagaataatagaaaatcataggaggtattatgagtagaccgacaaacaacatgtcagaagaactattcaaagtggatggaaaaacatctgtaggtgagacccttccacttgccctgcaacatgtggtggccatgattgtaggatgtgttacaccggcaattatcgtggctggtgtggccggactgtcagaacaagattctgttattttaattcaggcagcccttacgatgtcagcaattacaacattgattcaggtattccctctccttcggacagggaaaattgcaatcggttctggacttccggtaatcatgggtatcagttttgcctatgtaccgactatgcaggcaattgcaggaagatttgatatcgcaacgatattaggagcacagattgttggaggtatcgtagcggttttcgttggtatttttattaagcagattcgtaagttttttccaccgttaattacaggtaccgttgtatttgctatcggtctttcattgtatccaacagcaattaattatatggctggtggtgcgagcaatgaaagttacggttcctgggagaactggcttgtagcgattatcacactttgtatcgtaacagcactgaatcattatggaaaaggaatctggaagctggcatccatattaattggaattattgcaggatatatcatttcattattttttggaatggttgatttttcagcagtagtaaatgcatcctggtttgcgcttccaaagccaatgcactttggaatcaagtttgaaccatcttcctgtgttgcaatcggcgtattatttgccattaattccattcaggcaatcggagatttttccgcaacaacaacaggcggacttgaccgtatgccgacagatgaagaattaaatggaggtatcgtaggatatggattaagtaatattgtctgtgcaatttttggcggacttccaactgcaacatacagccagaacgtaggtattgtaggttctacgaaagttgttgcaaaaagagtatttgagacttcagctattattattctgattgcaggattaattccaaagttttcctctgtacttacaacgattccgtactgtgtactcggtggagcaaccgtttctgtatttgcatcaattgcaatgactggaattaaactcatcacaacagcaccgatggattttagaaatacaacagtcgttggattatcaattgctcttggcatgggtgtgacacaggcaaatgcagcgttggcaactttccctgcatgggtaacaactatctttggaaagtcccctgttgtattggcaactattactgcggtattcttaaatcttgtgttaccaaaaaacagtgattaaagaataatttattacaggcaaaacacgcgaaccatcaaagagaatataccctatatctgtgactttagtcgcggcggtttgaatgctcgcttatgcgcttatatccaaaccttgttctgaggccacagatatagggtatattttctttggtggttctatttgttccaatttggcaaatatgccgtcgtctgtagcttacctaatgaattaaatagcaatctctctcttgacaaatcttgaaagatgaatataatagatacagcgcaaaaaaagtttgatattgaacaattcaatgttgaatggtttgattctaaacaatttatacaaaggaataagaagataaggaggtaccgtgaagagagaagaaatgataggatttattgtgcgctctttggacaacatgatgatgcggaatgcagtgggcgatgagaagtccgagaagaagggaatgatgccggtgatgcaaggatggatcatcggttatttatatgaccataaggaagaggagatttttcaaagagatattgaggcagagttttatattgcccgttctacggtgacctgtttggtgaaacagatggagcagaaagggtatatcgcaagagtggcagtagagagagattgtcgcttgaagcgtctttgtcttctggaaaaaggagaaaaacttcatgaatgttttctacaaaatattgataatgtggagaaaaaggttcgtgagggaatcgatgaagaagaattgcagactttttttaaggtggcaaagcagattcgagagaatcttgaacagatgcagtaaggcaatgcaaagtgctgtgtgcatcaagagaatatataattaaaaaagaaagagaaaggacggtggtttagaatgataaagactcttgcaggacaggttaaagagtttaagaaagattctattattacaccaattttcatgattttagaggtgatcatggaaatgattattcctcttttgatgtcatcaattattgatgatggcgtggaaaagggagatattcatcatatttatattattggtatatggatggttgtggcagcaggcataggtttgtttgccggtattatgggaggaaagtacggtgcaagggcatcaacaggttttgcccgtaatttacgacaggcaatgtttgaaaatattcagacattttctttttctaatattgataagttcagtaccccaagtttggttacccgtatgacaacagacgtaacaaacttacagaactcctatcagatgcttcttcgtatgtgtgtgcgtgcgccatttagtttaatctgtgcaatgattatgtcattttcggtgaatgtaaagctcgcaagtatttatctggttgcggttattattcttggtgcgcttcttgcaattattatctggagggcaatgggatattttacagcaatgtttaagaagtacgatgacttaaatgaaagtgtgcaggaaaatgtttctgcaattcgtgttgtaaaagcatatgtacgtgaaaaatatgaaaagagccgctttacaaaggcaagtggtaatgtatatcgtatggcggtaaaagcggagagaattgtttcttttaacgctccattaatgatgcttatagtatactcctgtattcttggtattagctggcttggtgcaaagatgattgtacagtctgcacttacaacaggggaactcatgatgcttcttgcttattgtatgagtattttaatgaaccttatgatgctttccatggtatttgttatgctttctatgagtgtggcaagtgcagagcgtgtatctgaagtgttaaatgaaacaccggatattgtgaatccagagaatcctgtttataaagtaaaaaatggaagtattgtctttgaccacgtttctttccgttataataaagagggcaagaaaaatgtattaaatgatattgacctttctatcaaagaaggagagacaatcggtatcattggtggaactggtagtgcaaagtccagtcttgttaacttaatcagccgtctgtatgatgtttccgaaggacgtttacttgttggcggaaaagatgtaagggaatacgatattgaaacacttcgagatgaagtttctgttgtattacagaaaaatgttcttttctccggtacaattctcgataacctccgctggggtgatgagaatgcaacagaggaagagtgtaagagggcctgccatcttgcctgtgcggatgaatttattgaccgaatgccagatggttatcatacatatatcgaacagggtggttcgaatgtttctggtgggcaaaagcagcgtctttgtattgcaagagcccttcttaaaaagccaaagattctgattcttgatgacagtacaagtgccgtagataccgcaaccgatgcaaagattcgtgaagcatttgcaaaagaaattccagatacaacaaaattgatcatcgcacagagagtctccagtattcagagtgcagacagaattattgttatggataacggagaaatttccggttttgatacccatgagaatcttatgaaatccaatgaaatttacagagatgtctacgaatcccagactaagggtggcggagactttgatgagaacggaggtgaatagagatggcacggataaagaatatgaaaaatgctaaaaagatagagaatcccggagttttattaaaacgtcttatgggatatattatgaagcattacggggctgcctttgttacagtattgatctgtattttgatcagtgttatctgtaacgtacagggaacgatgtttatgcagactttgattgatgattatattgttccaatgctaaaagatggaagtcgtgatttttccggtcttgcacacgcaatcacaagagttgctggattttatgcgattggagtagctgttacactgttgtattcacagattatggtaaatatcactcagggtacgttacgaagcctgcgtgatgatttgtttacgcatatgcaggaccttccgattaaatattttgatacacatgcacatggagatatcatgtccgtgtatacgaacgatattgatacgttgcgccagatgatttcccagagtattccacagatttttaatagtggaattatggttgtcagtattatcgtatgtatgcttgtgttaagtgttccgcttactgttgtcagtctggctatggtcggcattatggtttatctttctaaacgtattgcaactttgagtggaaaatacttcgtacagcaacaaaaagaccttggtgcggctaatggttatatcgaggaaatgatgcagggacaaaaagttgtcaaagtattctgccatgaagaaaaaagtattgaagaatttaaagaattaaatgataaactgtttcatagtgcggataatgcaaataaatttgccaatattgccatgccagtaaatgcacaggttggaaatatcagttatgttatcgttgcgattgttggtggtattcttgctatcaatggaattggcagttttactcttggtggattagcaagctttttgacatttaataagagtttaaatatgccaatcggtcaggtcagccaacaggtaaactttgttgcaatggcacttgccggagcacagcgaatctttgagcttcttgacaaagaaccagaagtagatgaaggctatgtaactcttgtcaatgcaacagaagatgcagatggaacgattcacgaaacagacaaacatactggaacctgggcatggaaacattttcataaagaagatggaacaacaacgtatgccaagcttcttggtgatgtagaattcctcggtgtagactttggatacgatgagaagaagattgtacttcacgatatcaaaatgtttgccacaccaggacaaaagattgcattcgttggttctaccggagctggaaagacaacgatcactaaccttatcaaccgtttctatgatatacaggatggaaaaatccgttacgacggcattaacatcaataagataaagaaagccgatttaagacattccctcggaatggtgttacaggatacgcatttatttacagcaagcgtcaaagacaatatccgctatggtaaattagatgcgaccgatgaagaggttatcgaagcagcaaaacttgccaacgcagacagctttatcgaacggcttccacagggatatgacactgttcttactggagatggtgccaacttaagtcagggtcagagacagctcctatctatcgcaagagcagccatcgcagacccaccagtattaatccttgatgaagcaaccagttccattgatacccgtactgagaaaatcgtacaggaaggtatggatcgactgatgcatggaagaactaccttcgttatcgcacatcgcctttctactatcaaaaacagtgattgtattatggtattagaacaggggcgaatcattgagagaggctcccatgatgatttgattgaagaacagggaagatactaccagctttatacaggaaataaggcttagcttatttagcatctatttctttatcacatcataaagcacctttatcgcgtcctccacccccgttgtattgagataggaatagtttatgatgaaggtatgtgccgcaaaatcatctgggctgtcgtgatagtaggcggagaggctgtttagtttgacacctttttgtaaagctctctgcatgagttcttcatcggacagttccgtattgaccttgagtagaaaatgtagtccagagtcttcttccatgatggtgacataggaagcgagcgggctgttttttatggcatcaagaaggctgtctctttgtttatgatagaagtttcgcattcgattaatatgtttttcgaagcagccttcgttaataaagcgcattagagcgtactgttcaaagtttgagacggtacaggaatagaaacttaaccgttccagaaagcggttggcaagtttcggtgggagtaccatgtagctgattcgcattgttgaagatagactcttagtaaaggtattaatatagatgactttctgtgtgatatccatactctgtaaggacgggattggctttccagtcaggcggaattcactgtcatagtcatcttcaataatgtagcggtcggtagaggcggcggcccagccaagcagctcgtagcggcggcttatcggggtaacgattccagtaggaaagtggtgggatggagaaatatgtaccacatcggcttcacttttttctaattcatcgacaaggataccgttattatccattggaatatagtgatatgccacattgtagctgttgtagattgcggcaattttttcgtagcctggattttcaatggcatattttttgtcaaatcccagaagctggattaaaagtccgtataagtattcggttccggctccaataaaaatctgctccggctgtacatgcattccacgaaattgttccagatgggtggcgattgcctggcgaagtcccataattcctccgcagggtggtttcgtcatcagttctggactgtttgtattaaaagtctcacgcatcaattttgcccagatagaaaatggaaagttttccggacgtgtctggttgctggaaaagtcagcaagaaagtcagactgcccagaggaaagtttcacattttctgttgtcagtttgactggttttatcacattatttttaaaatcagagacataaaatcccttctttggaatggagtaaatatatccttccgataaaagctgagcataggcattttcaatcgtaatcgtacttacgccgagattttttgcaaaacttcttttggaagggagcttttccccggaaactaacttgccatcaacaatatcctgacggatacattgataaagatgcatgtatagagattcattttttaagtttgtaaaagaataggttagcattcgaattctccttaatgtatgtaatgtgctctcggtgtttttcttacaattacttttgtgaccgattttccatcagctgcacctgaaatttatcaacatgcgtaccgcgtatgcctcaaaaattttgacacaactgacaaaaaaatctcataaaatcaaaattaaaaagatttcaagagtacatatgtattattgtatacatctgaccatactggctgtatgcgaattggctatttaaatatggctaaagtgtactataatattatacttgtttctaatatttttacaaggaggatattttagtatggaagaaaataaaacatcggtcctcagtaatggactgatctggtttggtgcaggagtttcaatgtcagaaatcctgacaggaacatattttgcaccacttggaatgaaaactggccttctggctattttaattggtcacgttattggatgtattctgttatttttagcaggatatcttggagcaaagacaaacaataatgctatggagaccgttgcagtcagctttggacgaaagggaaacctgccattttctattttaaatattttacagcttgcaggctggcttgcgattttaaattatgacggagctttggcagcgaatggtattttttctgcaggagcaggtgtgtggtgtgccatcatcggtgtgttactgcttgtgtgggttctggtcggtttaaaacgtcttgaaaaaatcaatatggttgcgatgacggcattatttttaatgacagtcgctttatgttttgttatcgtgacaaagggcaacgcaggggcatttttaaacggcggtagtgtgagtggtgaaaccctttcttttggtgcagcgattgaacttgccgcatccatgccattgtcctggattccggtaatcagtgattacacttcaaacagcacaaagccagtaaaggcgacgacagtaagcacaattgtttacggactcgtaagctgctggatgtatattatcggaatgtctgctgcaatcggtatgggaacttctgatatcgcacagatttctcttcgtgcaggtcttggtgtagtcggacttcttattattgttttttctaccgttaccactaactttttggcagcacattctgcaggtgtttctggtgaagttgtcggggagagtttttctaaaaaaatcaatggaaaatacatttctgtcgttgtagttatcgttggtacgattgcggcaattctttatccaatggacaatatcgaagaatttctttatctgattaactccgtgtttgcgccgatgattgcagttatgattgctgatttcttctttaataaaaagagaagagctgtgaaagaatgggattgggcaaacctggctgtatggcttattggacttattttataccgtgcattgatgcatgtagatatcataatcggttacacactgccggatattgtaattactgctgtgttgtgcatggttgtacatcggattttaccacagaatcaccttgacaaagccatttaaatgtatgacaatatatcctaaaagaagtaccgcttttgtgtaaaatggtatttcttttaggattttttatagcaagaaaggcgataaaattatgtataacggaaaaatggaaaccatttatgaatcagaatatatgaacctgtatgatttacagtacagagagggtggccattactactgtgccagccgaagaaacaaggatagaatggttgcactgacaccagatgaagagtgtggaaccatgcagccagatgcagtaagctgtttcgttgttcttaatattaaggggcagccaaagaagcttctcttaaactgggagtatcgttatccggtcggacagtatatgttaagtgttccggcaggactcattgataaaggagactggaataatccgaatgctcttgtagatactgccattcgtgagttgaaagaggagacaggaatcgaagtggaggaatccgatgagatcaaagttgtttctccatgcgtattcagtacaccgggcatgacagacgaagggaacgctttagtatacatttccatcaaccgtgatgagatgccaaagatgaaccatgatggggcagaaggttcagaagtgtttgagggattccgtctggtaagtaaagaagatgccgaagaatatctttgtaaaggaagagacgaacatggaatgtattatccattatttacatgggctgcattgatgttctttatgggagtataactatatatgatgtatggcaactaaaaagcagggggaagttatatgagaaggatattgttaattggaagaagtgaaagtgggaagacaacactaaagcaggttttacgtggggagaatattacctataaaaagacacaatatgtcagccagtatgactgtgtcattgatatgccgggcgaatatgcggagaatctggatttggcgcatacgattgatctgtatgctgcagaatccgatgtggtaggaattgtgttaagtgcgacagaaccctattctttatatcctccaaacataacaccgcttggaaaccgcgacgaagtgggaattgtaaccaagattgaccactgggcagcgaatccacagcaggcagccgaatggctaaaactcactgggtgtaaaaaaatattttttacaagtgcctatactggagagggaatcgaagaaatctttgaattcctgcgggaagaacatgacatttgtccagtagaaaaagttatggatgcccttcataaagaaagctttggaaagcaggcagaacttcctcactatcaccttcagtaaatatattcaaatatactccgaaatgaaacaagaagccttgacttttgtaagttacacgctctaagagtagtgtactcttggagtatgtttcaagcacgcaatgaagaattttcacacacgttttaaaatgtctgcttttgcattggattttgagaatgtacagaatttcgagagtagataaatatttagaaggagaatgacttaatgatacttcagattttacttttatgtgtcggatttgtccttttagtaaaaggagcagatttttttgtagatggtgcagcaggaattgcagggaagttgggaatcccgcaattgattgtcggccttactattgtagcaatgggaacaagccttccggaagcggcggtcagcattacttccgcattaaagggaagtgccggaatcactatcggtaatgtagtaggcagtaatattatgaatgtgcttgttattctaggaatcacagccgttataacaaatgttgcgattcaaaaatctactttgtattgtgagattccatttatgataggaattacagctttaatgattgtttttggaataactagacgggcagtcagctttccagaaggcgttatattttggatattgtttatcgctttcctggcctatctttttgtgatgtcgaaaaagaataaagcggctgaagaagaagatgaatgccagatgtcctatttaaaatgcattattttcattatcgctggaggtattatggtagtctggggcagtgaccttgttgtagatgccgcatcagagattgcaagagcttttggcatgagtgagcgtttcatcggtcttactattgtagcctttggaacatcacttccagaactggttacttcggttactgctgctaaaagcggtaatgccgggattgccattggaaatatcgttggaagcaatatctttaacattcttttcgtaataggaacaactgcattgatttgcaatgtaccatttgaaagcaagttcctgattgactctgcggtggcagtagcggcaggtgttatcctatggcttggaacgatacgccataaagaacttcgcagaccatgcggggttgtaatgcttgtggcgtatgtgggatattttgcatatctttgcatgaattaaacttcttaattttacacattagattttataagttagcgagctatctccagccaaaaacagctctcaaagaggaaagcccctatatttgtggccgttaagcgaacattcaattctcgctttaagggcgcaaatataggggctttcctctttggggcatctgctcgtttaggagcatcctcctgcttgcggtagatcagtgtttcacacaatatcccgccgcattacaacccgtatcccaataccggctactactactaaacgtactgatcttcactttccccgcagtctgtgaagcatgaagaacctttccatttccaagataaatcccaacatgattagagccgttctgatggaacaccaggtctccaactgttgcctgtctgacagaagaaatcgaatacagataagaatgcatcaattctaactgttcataggttgtgtttccgatatatttgccggaagcactcttataagcgtcacgcatcagactagagcaatcagcatatcctttctggtttcttcgagactggctgtatttatcgccaactcttctttttgcgtaggagactgcttttgttcggtaactgctagaagaagcagtagtagttttcttggctgtagtctttgatgatgaagcacttttcctaacataaattccgtatacatagccttttttgcccttggaagtttgtacttttttccaggagccatttgtagaacaaaccgtcacagcctgacctgcagataaactaccctttacacggctagaaaaagaaggctttgcgcgcagattcacactacttgctgtaatgactgcacggtaagaagtacttttagagactgtggcagtagaagtatttttacttccagacagataagatttgtaaatataaccttttatgccatttaccctgacggcaatccagtttccacttctaccagttttcgttacagatgttccggcagaaacagatgtaagtactttcgaagaactgtttggttttgcgcgcacatttacaccgtctgtcgtatatagacgttgtgcgtgaacaaaagttacagggagcatcaaaaaaagtagaagagaaaaaagtattgccgtatgattcttttgtatgaatttcggcagatgcacaacttttttcgagtgtttgtttgcgttcatagatgacacatctcctcatatgtaatttgtaataaattgtaacacatttttaggagaaatttaagaaaaaatttgttgaaaagggcaagaaatttgttcttttattaaaatgtttgtgggatgtcggataactgttgaaattgtgtaatgctctatgctaccatggatgagaaaaggaaaggaaggtaatgatgaaaaagaaatacatagcatggatattgatagtatcaatattatttttgggacggggagcagatgcgatggcaaaaacaagtttaaggaaacctcttggtgtgctggcaaatggagtagatggccaggtggtactttcctgggaatcagtgcagggagcggatggttatgaagtgtttgaaaaaacggaagaagaaaatgttttcctgaagttaagggcgacaaagcaatgtaagcttgtctttaaaaataagaaaagagggagtgtataccaatataaagtaagggcatataaaatatacaagaagaatggcgaagagaagcgtatctatagttcttttggggcggttgccagaacaacggtagcaaaaaactcaacttctacgattaaaaattttctgacaacggcacttgctcctgtaggttctaccatgtatatctggggcggtggctggaataaggcagataccggggcaggtacagacggtctgcgaattggactgaatgcgagctggaggaagttttgtgcaaagcagaaagcaagctataattatagaaagcacaggtttgcatttggaaatggactggattgttctggatttgttggatggagtgtatacaacataaataaaacaaaaaatggaaaacagggtcagggttatgttacaaaggcatcgaaagcagcatctacttatgcaaagtacggctggggaacctataaaaagacgatagcggtaaaggactggaaaccgggggatattatgagttcacctacgcatatctatattgttgtgggaagctgtgcagatggcagtgttgttttagtgcattcgagtccggcaggagtacgcctgtctggaaccccagataaaaagggacgaacaaacagcgaggcagtaaagcttgccaaaaagtatatgaagaaatattatccatcctggtataagagatatccatcctgcaaaaaagataagagttatctgacggattatgcacagttccgctggagagcaggaaagggaaagatgataagcgacccagatggttaccagaagaaaaatgcaagacaggtgcttaaggatttgtacagtgataagtaaatgttgttgtatgaagtaaaatataagtattttatcacagaagaagtatgtcatgcattgcatgacgcgcatctcacagcaagaatgctgggacattcttgaatcttaaataatgtattctgataaaagctgttttgagattctgttattttttcttgaattgaagaagaaaagtagaaaaataaatagaaccaaagaacagaaattcacaggcaaagtaaaaaatagtttatgttcagtatggcaatttcgtggtaaaatacaaataaaaacggtagaaggctattttaccgtaaagtgaatgaaatgaggagggcaaaatgaaaagaaggattgatgcccatgtagtgatggagaagcttgttccacggattacggaagagtatcgaaagatttatgacatcccggagaatcatgagagcatggctattttttcggcagactgcgaggatgttatgtggcttgcagtggatgatgcgactaagaaagccaagattaaagttattcagattgagacggtttatggcggagtggattattcgtggagcagatatggcggagagattacggcgattatttccggcgagaaagttgcagatgtgaagagtggacttcagtatgcaaaggattatatagagaataagtcgggaaattattctttaaatgaagaggggacacttggctattatgtggattatgtaccacggatcggaaagtattatcaggagtctttgggacttagtgagggaacttctattgcctatcttgtatctgcaccggtggagagtatgtatggactggataaagcgttaaaagcagccgatgtgaagattgcagaattatccgagattccttcccgtgttaatacaggtggcgcgattgtatatggaacggaatcggcatgccgctctgcagttgaggcgttcgcagagggtgtggagtattgtgcgtttcacccaatggatattgagtgattgagcaggatattgcttatgttacatacatgatatgcatataagtgttatgaatgtaatcaggtattaaagtgatacggtgttataaaaggcagaatacattatttagaatgattattgaaaatattgtgatgtttaaaatgataataaaagttctgtcggaagcgaaaggattttgtttatgaaaattgtaaaaatggaaacgcatatgctcagccagaaagtcattgcgaatgtgacaccagagtttgcgcgtgtgtataatataccggaaggacatacgagtgtcggatttttctcggcagataatgatgatattggttatctggcagtggatgatgccagcaaaaaggcaaatatcaagctgattcacgcagaaacatactatggaggaacaacatgctcctggagtaaatacggcggcagtgtatttgtattgttttccggaccgaaggtagaagatgtgaagagtggacttcgatatgtaagagactttatcgagaatcattcggaactttgtaactttgacggggatgagggaaccgcattttatgcacagacgattccaagaccgggaaagtattttcaggaatggtgtgagcttaagcctggcgaatcttatgcctatcttgttggtggcccgattgagacaaactatgcattagataaagcattaaaggcaggcaatacccgcgtggcaagatattggtatccgccgtcacatgcgaattccagtggagcggttcttgcgggaacggaatctgcctgccgggcagcgacgaatgcatttgtggaagccttagagtatgcaataaagaatcctcttgaggtataaaatatatttcaaaaaaattctggacattttttttaagctgtggtagactgattaagatttgatgtaaaggcgatgacgaagagaagtagtgggaattatcgcttccagagagtggggatagctgagaaccctgcagaatgaattcctgtgaataacactttaccagccgcaatctgaacgaaatctgtcaatacggacacaggcagattccttagtaggtgcgccgtgactgtgcgttagacagaagttggttttgagtgactgcttttcataaggcagtaattcaggtggtaccgcggaataatccgtcctgaactagttttagttcaggacgttttttattgcataagatttttatcttgtgggctattaaagaagaaagatagatttcctttgagaatgaaattgtgactttattctttttcagcaagaagactcctacctctaagataggaaatgaattgtatttgttacccacttaattgataaaaatatgatgaaaagctgtattataagaagggagatttagataaatgaatattgcaaacatttacagagacaggactcttgatatgcttagcgaagaaaacgttggcgaaactgtccgtgtggcaggctgggtagagaatatccgtgaccacggcggagtatcttttattgacttaagagatatgtatggtgttcttcaggttgtaatgagagatactactttattagagggaattaacaaggaagactgtatttctcttgagggtgtgatcgagcaccgtgatgaggagacttacaatccaaagattcctacaggaaccattgaattagaggctcataaagtagatatgctaggaaaggtatataaacagcttccatttgaagtaatgacttctaaagaaaaccatgaaaatgtacgtctgaaataccgttatcttgatttaagaaataaaaaagtaaaagataacatgattttccgttctaaagtaatcagcttcttaagacagaagatgacagacatgggcttcttagagattcagaccccaattctttgtgcttcttctccagaaggggccagagactatatcgtaccatccagaaagtacaaaggtaagttctatgcacttccacaagctccacagcagtacaaacagcttcttatggtgtctggatttgataaatatttccagattgctccttgcttccgtgatgaggatgccagagcagaccgttctccaggagagttctatcagttagactttgagatgagttttgcaacacaggaagatgtattccgtgtaggtgaggaagtacttacagcaacatttgaaaaatttgcaccagagggaagtgttgtaactgcagcaccttatccagttatcagctacaaacaggcaatgcttgagtttggttctgataaaccagacttaagaaacccacttcgtatcgtagatgtaacagactttttccagagatgtacctttaagccattccacggacagactgttcgtgctatcaaggtttccaataagatgtccaaaggtttccatgagaaacttcttaagtttgccacatcgattggaatgggtggacttggttacttagaagtaaaagaagatttaagctataagggaccaatcgataagtttatccctgatgatatgaaggcagagattcgtgagattgctagccttaaggcaggagataccattttcttcatcgccgataaggaaaaacaggcagcactttatgccggacagcttcgtaacgaattaggacagcgtcttgatttattagagaagaatgcatatcgtttctgttttatcaatgacttcccaatgtatgagtatgacgaagaacagaagaagattatcttcactcacaacccattctctatgccacagggcggtttagaagcgttaacaacaaaagacccattagagttacttgcttatcagtatgatatcgtatgtaatggtgtagaactttcttccggagccgtaagaaaccacaaccttgatatcatggtaaaggctttcgaaattgccggatatacagaggaagacttaaaagaaaagttcggtgcgctttataatgcattccagtatggtgcacctccacacgcaggtatggctcctggtgtagaccgtatgatcatgcttcttcgcaatgaggagaatatccgtgaggttatcccattccctatgaatggtaatgcacaggacgttatgtgtggtgctccaaatgaagtttccgaaatgcagcttcgtgaagtacacatcaaggtaagaaaataaattcaaagtattttcagatatgttttcatgcgctgtaatgttaatgaatgacgtaacttttatctggacttttaatatatttcctacaacgtgtttgaaaaatctgccagaacattttttaaacacgttatagcagagaattattagtatttatacaaatgaaaatgggggtttatctttggcatagggttaattatggaaaaatatctttttatgttatatttttctgtattttagcgtgctatagatgaatctcctttttttgtgcggttagtgcagcctgcaatgggcacctattcagaaaaatcaaaaatatctataggcattaagtagtagtttgtttcagcttgatgaatatcgtttacgaagcgcttttgtgcatttgttcagatgaacttttctatagattatgatatatatatctgttggagcaaaagttattttcgaatgcagaaatagaatttataaataaactttcttttgtatttatgaaaatatatataaagaaaaaatatgatttcaaatgaaaagataaaggtaaattttaattgctaaaaaagatactttttgagaaaaaatacataaaaggtagaaaaatatgtgtggaacttttaaaaaagtaaccaaaaaacaagaaaaaccgtcaatattcttgtttataacaataaaaaacatttacaaacaaaagcattttttggataatgatattaacatttcatgaagaaaaataagttataggaggatgagtatggaacgtttgatttattttgcaccggttcttggaatctgcgcattgctttttgcgttttatcttacaaaaaaagtaggaaaacaggatgcaggaacagatagaatgaaggagattgcagcatttattcatgagggagcaagagctttccttactgcagaatataagattcttgtcgtttttgttgctgtattatttgtactgattggtattggtatcggtaactgggtaactgcagtatgtttcttagtcggagcattattttccactgcagccggttatatcggaatgaacgttgcgactaaggcgaatgtaagaacagccgcagcggcaaaagatagcggaatgaataaagctttatctatcgcattttccggtggtgccgttatgggtatgtgtgtagtaggttttggactttttggagcaggtgttgtatatatcctgacaaaaaatccggatgttctttctggtttctctttaggagcttcttctatcgcattgtttgcccgtgtaggtggcggtatctatacaaaggctgccgacgttggagcggatctcgtaggtaaagtagaagcaggtatcccggaagatgatcctcgtaacccagctgttatcgctgataacgtaggtgacaacgtaggtgatgttgccggaatgggtgctgatttatttgagtcttatgtagggtctttagtatctgccatcactcttggtgttgtttacgcaaaagagagcggagctattttcccattagttattgcagcacttggtgtattagcatctgttattggatgtttcttcgtaaagggtgatgagaattccagcccgcacaaggcattgaaatacggaagttattctgcagcaatcgtggtaatgattggttctttaattttaagcaaaatgttcttcaacggattcaaagaagctatcgcgattatctttggtcttgttgttggtcttttaatcggtgtaatcacagagatttatacgtctggagattaccgttttgttaaaaaaatcgcacagcagtctgagactggtcctgcaacaacagttatcagtggtattgccgtaggtatgcagtccacagccgttccgattattttaatcgctatcggaatcattggggcatattctttcagcggtctttacggaattgctttggcagcagtaggtatgctctccacaacaggtattacggtagccgtagatgcttacggtccaatcgcagataacgctggtggtattgctgagatgtctggccttccatcagaagttcgtaacatcacagacaaattagacgccgttggtaacacaacagccgctatgggtaaaggtttcgctatcggttctgcagcccttaccgcattagcattattcgtatcttacgcacaggcagttggattattcgaagaaggaatcaacttattagattataaagtaattgtaggtatgtttgtaggtggaatgcttccattcctcttctccgcatttacaatggattctgtatccaaagcagcatataagatgattgaagaagtaagaagacagtttaaaacaattcctggaatcttagaaggaaaaggaaagccagattataaatcctgcgtagcaatctctacacaggcagcattaaaagaaatgcttctcccaggtgttatggcagtacttgcaccagtatttatcggcgttgtacttggacctgatgcgcttggcggacttcttggcggtgcattagtaacaggtgttatgctcgcgattttcatgtcaaactccggtggagcatgggataatgcgaagaaatacattgaagatggacatcacggcggaaagggaagcgaagcacatcgtgcggcagtagttggtgatacagtaggtgatccattcaaggatacttcaggaccttctattaatatccttattaagctgatgacaattgtatcattggtatttgcaccattgttcctcaaaatcggaggattattctaaagtcctgatttgtgaggctgcggagcagacgaactcctgaagataaatggtgtgcatcccgtcaaatctttctcaaaataaattctgagtttgcataggcagccaaagacagctcccaaagagagagcataccctatatttgtggcctcggagcaaaggttggatgcgagcggttaagcgaacattcaacctgcagcgactaaagtcacaaatatagggtatgctctctctttgggagcgtctcctttgcctgcggcaatcagaatttgattaaactactggaatgcttttaaatgtcatgatattatagtgttagaaaacatataatagggtgagatatatgagcggagaattgataaaggtaggtaaatatgatcttaaatataataaaatattagacattgatattgcagagttagatatatatcgttctacaggattgccagcacatatggttaaacgtaaacatttcaattgtctaaaatatatagatgatattcctgatattttggaaaatccagactacgtgggagtaaatcctaatgaaaaggacaagtccatagagtttgtaaaaaagtattcaaagaatgttttacttggcgtgaagttagaaaaagaggggcaatatctatatatttcaacaatgtatgaggtgcaggaatccaagcttaacagacgtttatacagcggaagactaaaagaaatgtccgttgacaatgtaaaaaaaatatagtatattgttaatataacagaatatagtaatactgagcatgattattttgaggtcggaaatggttcccgacacactccataaggagtacctgagatgatggatacaccgcccatccaaagtgattgtgctttttattatttaaatcttgtattttcggatgcatactcctatacaggaacggtatgttcagatgggacggaggaggaagtagaactacaacagtgaaaaaagatatggaataagagcaataaaacacagtttaaaatatttggatggaagagtaaaaaaaatatctaccataataaggtgttgtagtatgattaaagaagaatgcaagatacttattaatgaaaggaaagaatgtaatgaaaaacaaaatatctggtaagatagtggcactcttacttacacttattatagtagccacttctggcatgccactttatgcaaaagagacaggagataaggcaaatagtttccgttatgagaatggacagtcaatcgcaaaggcagtaccattttctacgctttctccgaatgcctggaagaagatagatggaaagtattatagcggcgatggaagcgtaattgaaggagctgttgcaaagggaattgatgttagtcaccatcagggaacggttgactggaaaaaagcaaaagaggatggtgtggaatttgccattattcgctgtggatttgggatgaatcagacaaaacaggatgatgcacagtggtttaataatgtaaaagggtgtgaggagaataatattccatatggtgtatatttatattcctatgccgatacagtaaaaaaggcgcaaagtgaggcggagcatgtacttcgactgataaaaggccatacattagcgtatccggtatattatgatatcgaagaaaaagctgttttgaataaattgacagcagaacagttagggaaaatagcagcaacctttgtaaataaagtgaaagcagaaggataccagacaggtatctattctaataagagtaattttgagacatttcttacggacagccagtttagtcagtggaataagtgggtagcacaatataattcagcagcatgtacatacaaaggaacgtatcagatatggcaggcagccgatacaggaacaatcgatgggaaatggagcagtagatatcaattttgccatgaaaactacctcatcaagcgataacaatccaggaacatccacggaaaaaccagccacatcagccaccaaacctacgacaactgcagcaaaaaataataccagaccagcacctgtaaaactacgcacccctacaataaaagtgaaatcttctgcaaagaaaaaggcacagattatatggaatttaaaaggaaacggcgtaaaataccaagtatattattccaccaagaaaaacaaaggctataaaaaagccgcaacaataaactcatccaaaggaaaagctactgtaaaaaaactaaaatcaaagaaaaaatactacttcaaagtccgctgttcaaaaacagtcaaaggacacacctactatagtgcatactcaaaaataaaatcaatcaaaataaaataactcttaaacaaactagagcgtgtttcaaacatccccggagaggaccaaaatcactcagcagtttacatcccccttcccttatggtatagtataatcgtttgattacaggcggatgagaggaagatactatgagaaaaattatgtttatcggacgaagcgaggcaggcaagactactttgacccaggcgatgaaggggaatacaattacttaccataaaacacagtatgtcaatcactatgatgttatcattgatactccaggagaatatctccagtcaaagaatctgatctcagcattggctgtttttacagcggaggcagatgttatcggacttttgatggatgcaacagaacccttttccttatattcacccaatcttacaccagtctgtaacagagaagtcgtgggtgttgtgacaaagattgatcactgggcggcgcagccggcacaggcagcggcgtggcttgaactggctggttgtaagaagattttttatacaagtgcctatacaggtgaggggattgcagatattctttcctatttaaaagaagagagagatacacttccatgggaagaagtaaagtctaaatatgatgaacttggctttggtgcaggtgaagatgcgaaagatcaaaatagatttcacaatatataaaaagggtggattatttgcaaagattgttttataatgaatacagaattttatttaaataaaacgggaggcttactatgagaggttatgaagcagcacagattttaaaagaaaagggaattacggtagaagatgtcgcagaagaaatcacataccgcaaagagacgaacgcttttagcaataatccaaagaacgaggcattcatgaatatgaccctgaatgaacttgtaagaattaaagagatgtggaatatctaattgcacaagtgtatacggaaaaaagagctgtcctgtgaatggatggcttttttctgtactatatgaagtctgcttttaccatgctcaaatatagggttttttcgtatgatgcaaatgaaaggattttatttatgaaactaggttcaggtatgtataaagagattgcgcgggatgcgctgaaaggaaattggatgaaggcgattgcagcaggatttgcagcaggatggcttggcgttttttcgtcctcttttttgtttattgcaggatatgttttagtggcggttatccttgtttattttcttgaattccttccgggattttatccaattttatttcttggtacgacaatcatagcattgatttacttttttattggaggagtaatacgtcttggttatattgattttaatctggctctcttagacagaagaaagaacggaatctatcgtctggggagcagaatgtctgattggtggagagtgctttgtgcaaagattacattgttttttgctctgtcactgggatatgtcttgctgattgcgccaggaattatcacaaaatattcttatgcgatggtgccatatattcttgaggaaagaccagactttacagtgcacgaggcatttaaagcatcgaaacagattatgaaaaagcataaatgggaactattttgtttaagattcagctttattggatggtatattattggaatattaacgcttggaataggacttatttttattaatccatatcgttatgcggctgaggcagcattttataatgagatatctggacgggccgaagcgtattatgggagaaaagaggatagatattagtaaaaaatagcagaggaaggaagggggagaacaaaaatcttccttgcatcagagaaagtattttgttaaaatatgagaagtttattacaggatacgaaggaaggaagaacaataatggaaattttagggaaagtgctttctgaaaagacagaagccatttataaagacattacaggaggactgatttatccgattaaaatcgtaaagttagatccggagaatgaggaagactgcagccgtccggttgcaatggataccggaaagaaagaatttattgtaaaagtagataatactttagcagataacctctttgaaaatgcgctgattcgtgatattatttattgtcagcagatgagtaataacgcaccggtattaactgcgaagagtagaaatgatattgatggatttcaggtggcgatgatgattagctctattatcatggatattgatgtagagaataagttaagaagctatgatatgcatattgatgatattgatacgatgcgtttgagtgatttgtacgcatttttgaaatctggaatggcagactataacagagagttatataatgtctttactggacttcagattacactgttatattttacgacatcaaagagaagtaatatagaagagattatcgagacgttctatctttctgataagagtgcgatggatgcgattgataaatatgtagatattattgaccgttacggggtagatgataaccgctctatgatgcgctgtatgagaaagcttgcaattgcctgtggaatgaaaggcagattgctacttgagtatgaaggtaaagtaacagaaatttaatgacatagatcctgtagctgctgcgacaagtaattttaccccgacagaagttacaggattttttgtaactatgacaatgtatagtaattccataggataacgatagtataatgggttttctgatgtattatatggaattattatagattcaacaaaacgttttatgaacaggatgaatgaggatgaatatacgggaatatttagaaaatcataaactattaacagacggagcgatgggaacgtattttgattctatagaaaaagaaaattacatctgctctgaggaagccaatattacgaatcctgcgttggtgagagaaatacatagaagttatgtgaaaaatggggcgcagcttttaagaagtaatacttttttggcgaatgaaggaactttcttgtctttgacacaggcaaaggcagaagcgtttgaaaatataacattgaaacaattaatcattgcgggttaccaattggcaaaagaaactgcgcaagaagtatatcaagaggaatatccgatatttgcagcggcagatatcggccctattttagaagaaagagacagtgaagaggcagacattttacaacagtattatgaaatatgtgacagctttttagaggctggtgctgatatttttgtattagaaacatttccggatacgcagtatgtcttaaaaatggcagaatatatcagaaagagttgtccggaagcctttattatcggtcagttttcattgacaccaacgggatatagccgtactggttttcattataaaacgattttgcaggaggctacccagagtggactccttgatggagctggtttaaactgtggtgttggtgcagctcatatgaagaaatttttaaagagttacattgaagagtttggtgtgccggaggatatggttctcacatctttgccaaactgtggctatccacagattgttagaggccatgcagtatattcggacagcgtgccttattttggagagaaacttggagaaatttctgaattgggtgtgcaggttcttggtggctgctgtggcacaactccagaatatattggagaaatttataaaacggtatttcaggcgaagaaaacagaaggtgctgttaagattccaacaaaaatagtgtgggggatgtgacaaagcgagtacaaaaaagaaaagaagcagctgtacacatcacacaggcaggagaacagaaagaggctataaaggaaaagcaggtaacaaatacatttcgtcagaaattagaaatgggagaacttgtttgtgctgtggaacttgacccgccatttgatacagatgatacaaagctgcttaatggtgcgaaggcgctgctttctacaaaggcagatatcattacgattgcagattctccgctcgcccgttcaagagcggatgcttctctgatggcagcaaaaataaaaatgacaacaggaatggatgtgatgccgcatctttcctgtcgtgataaaaacaggattgcaatccgtagtggattacttggaagttacgcaagcggtattcgcaattatctgtttgtgacaggagacccggtagcacgagaagacagggagtttacaaagagtgtatttgactttaattccatccgtcttatgaagtttgcacagagcatgaatcaggaagtatttaaggacgatacgattttttatggcggtgcgctgaatcagaacggggcgagtcctgaaaatattgccggaagaatgcttaagaaaatggaggcaggctgcagatatttccttacacagccggtttatgataaagagggaattgagcgtcttacatttttaaaagaaaggacaggagcaaagattttaatcggaatcatgccgcttgtcagcagaaggaatgcactttttatcaaaaatgagatgccgggaattcatgtgccggatgaagtggtcgcaaaatataaagaaggtgcctcaagagaagaatttgaggaagcggcaattgagatttcaaaacagattattgagatggggaaaggtatcggggcaggattttattttatgacaccatttaacagagtttctctggttaagtcaatattagaatatgtataatcggtgcttttgagataacaaaaagaaaaatcaatcagcatcataaaaaaatttgaaaaaatggattaagacaaaaccagttgagaaaaatttgaaataaagaataagttaaataagcataaagaaaatataaatataagtaaagggaaaacaaaaaatgaagacagaagaactttataccatgatacaacaaaaaccggttattttagatggagcgaccggttcaaatctccagaaagttggaatgaaaccgggagtatgcccggaagaatggatccttgaaaatgaagataagttaattgatttgcaaaagtcttttgtggaggcaggaaccaatattttatatgcgcctaccttttctggaaaccgtgttaagctagaagaatatggactggcagaccgcgcagaggaaattaataaacgcttagttggccttagtaaaagagcagcaggagataaggctcttgtggccggagacatgacaatgactggtgtggctttagagccggtaggtccgatgaagcttgaggctttaattaatatttataaagaacaggcaaagtatttgttagaggctggtgttgatctgtttgttgtagagacgatgatgagtctcgctgagacaagagcagctgttattgccattaaggaagtgtgcaatcttcctgttatcgcttctcttacttttcaggaagatggaagaactttatatggaacagacccagtcacagcagttgttgtgttacagagcattggtgcagatattatcggtgtgaattgctctaccggtccgggagaaatgatccctgtcattaagaaaatgaaagagtatgccgaagttcctattcttgcaaagccgaatgcaggactccctgtgttagaggatggcgtaacggtatatccgatgacaccagaagagtttgcttcctgggggccggcttttattgaagcaggtgcaggactcatcggcggatgctgtggctctaccccagaacatattcgaatgcttactgaaaaagtttcgggcctcacaacaaaagctccatgcaacatacatccaattatgcttgcttcagagagaaagagtcaggaaatcgctcttgacggaaagttccttgttattggtgagagaatcaatccaaccggaaagaaaaaactgcaggaagaacttcgtgccggaaaacttgaccttgtagaagagatggcagaacagcaggaagaaatgggggcacatatccttgatattaatatgggaacaaacggtattgatgaaaaggagatgatgttaaaggctatctctaaagtaacaatggtatcaagccttcctctttgtattgatacaagttatgtggaagttatggaggcggcacttcgcgcttatccgggacgtgctcttattaactctatttctcttgaaacagagaaaattgaaaaacttcttcctttggcgaaaaagtatggagcaatgtttattcttcttccactctctgatgaggggctgccaaagagtcttgcagaaaagaaagaaattattaatacaattttagaaaaggcaaagaaacttggcgtttctaagaatcagattattgtagacggattagtaacgacagttggagcaaataaaaatgcggcattagaaacgttagaaaccatccgttattgtaaagaagatttaaaactttgtactacaatgggcctttctaatatttcctttggattaccagagagaccatatgtgaacggagcttttgcttcaatggcgattgcaagtggacttacgatggcaattgcgaatccatccaatcagcttttaatgggaatttcctttgcttctgatttgcttcgcaataaagaaggttctgatattgcctatattgaacagattcagcggatggaacctttaaaagaagctgcaattgcaaaagcagcaaagacagccggaaatggagaaaaacagccgaatgaaaagaatgcagctgtcggggaggcagatgggaatattaagaaaaatccagtatttgaggcggttttaaagggaaataaagatggaatcgttgatgttgtaaaaaaagaactttctaaaggaacaaagccaggagaaattcttgatggtttgctgattcctgcgatcaatgaagtaggagtgttatttgacaaacagaaatatttcctgccgcagcttatttccagtgcgaatacaatggaacaggcggtagaatatttagagccgctattaaaagaaggcggcatacaggaaaaaatgccgacaatcattattgctacagtagagggtgatattcacgatatcggaaagaatcttgttgccctgatgcttcgcaactatgggtatgatgtaattgatcttggaaaagatgttcctgccgatgaaattattgcagcagcaaaagaacataatgcgtcaattatcgtgttatctgcattgatgacaacaacaatgatgcgtatgaaagatacgattgccttaaaagaaaaagagcatcttgacgtgaaagtgatgattggcggagcggtaacgacacagagttttgctgatgaaatcggagcagatggatattctgcagatgcagccgatgcagtacgtcttgccaaaaagctcttagcagagtaaaatgtctataaaatagttactcggagtcttttcttatacttatttttgcggccgtttttttgtcggctgcacccggttttcatgtaaaatcagtacaaaaagattctacgagtatataaaattaaaaagggagataagaatgagcgagacacgaaaaattgatgtcattattccgacatatcatccagatgaaaagttagaaaaatgtcttcgtatgctaaaaagacagacagtacagccacagaggattcttttaattaatacggaagaagaattttttcatagcaaggtgttttctacgttaaaacagggggagattatccatatcaccaagccggaatttgatcacggtggtaccagaaaccaggcagcagcaatgtgtgatggtgagattatgattcttttgacacaggatgccattcctgcggatgaacatttaattgagaatttaattaagccatttgaagatgaagaagtctgtgcggcatatggcagacaaatggcagataaaaaggataatccagttgaggcgtacacaagaatttttaattatccaaaagaaagcaggattaagagtaaagaagatttgccgaagcttggaattaagacatttttctgttctaatgtctgtgcggcataccgcaagtcagaatataatgcgcttggaggattccctctgcatacgatatttaatgaggatatgatttttgcttctcatcttattgaagcaggaaagaagattgcctatgcggcagatgcaaaagtatggcactggcataattataccgcgaaggatcagttaaagagaaattttgatcttgcggtatcccaggtagatgccggcgggctttttactcaggtgaagtctgaatctgaaggaatccgtctggttaagatgacgttaaaacactttattaaaaagggacaattttattatattccaaagatcattacacaaaatggtgcaaagtatattggatatcgtcttggaaaaaactataaaaaacttccgaaaaagtggattcttaagatttctcttaacccgtggtattggaaataaaaattggggaatgcagattgcaggaatgatttttcaaacacgctttagcatagcaagatatcatatttgcaaaaagaaggtattacagacatcattttgcaaaagaattcgaaatagtttaaataaactttaagaaattttgacttgcaatagaggaaaaattagtataatgtataaaaagagtttttttgtacaggaggttttaaagtttgaaagagacagataaaaacaaaaatatagacaaaaaagaagccaaaaaagcgaaaaaggcccgcaaacgtggaagagcaggccggagaattgcgcaggtgcttatgtgctttcttcttacagtagcttttgttgcttcagcagctggaggagcggtggcagcctattataaagcagcaacgaatacgattacgacagatacaaagacagcattgaagaacgcggatgtcgtagatgcagatcttgagtatgatcaggatgtagtcaatattttactgattggctgtgacaagcgttccgatgagacagaagccggacgttcggattcgactatgatcgcaacgatagatttgaagaatggtaagttaaagcttacgtctcttatgagagatatgtatattgatattccaggatatggataccataagtttaatgcagcttattcttacggtggtgtacagcttgagtatgagactattgcagaaacatttggcattaagcttgatggctatgtggaagtagacatggaagccttccgtgaggtagttgacttgatcggcggtgttccaatggatctcactgaggcagaagcttatttcttgaagactgcttatgtaaattcaaaacatggagaaaagaatgtaaaggcaggggagaatatgcttacaccatatcaggcattggcatactgccgaatccgtcaggatattactggagagtttggacgaacagatcgtcagcgtaagattcttatttctgtatttaatgaattaaagagcgaagatgttatgacaattacaaatatctgcatgaaagcattaaaatatgttacaacagaccttacggaaaagcagataagaagtcttttaacttcagtgatcacaatgggagcgaccgaagtagaacagttccgtattccatatgaaggctcttatacagaaggacgtcttagtggcaatggagcatgggtaatgcaggtagactacgaagcaaataaaaaggcgttacagtactttgtttttggtattggagaagatccgggaatcaatgattcttatggagttggtaacgataaatttataaaaggatactatccggagaagacggagggtatctctacatattaatttatgttagtggaggaaagtattatgagacagattgttttatctcttttagtagataataacccgggagtgttagcaagagttgctgctctgttcagccgtcgtggatataatatcgacagcattacggcgggaatcacgaacgatccgaagtatacccgtattacagtagcagtaagtggggataaccagattcttgagcagattcgtaatcagattgccaagctggttgaagttcgtaaaatcgtagaacttgagaacagccattctgtatgtcgcgagcttgtccttgtgaaagtgatggcagataagaaagaaaaacaggagattattgcgattgcagatattttccgcgcaaaggttgttgacgtagctgctaactcccttatgattgagcttactggtaaccagaacaaactagatgcctttttaaatcttatggcagactttgaagtccttgaaatggttcgtacaggaattactgggcttggaagaggcgtaagtacactgaattgattttaatataataatatactgtagtttgaaataagagcaataactataattttttactattaaagaaaggatatgcatttatcctttctttttttacgggaaaaaggcgtttttttaaaataaatgcaggaaaaccggtaagttgattcattttttaagaaaatttttaaaaaaataatcaaatatcccttgatttctcctataaagaggagtattataacgattgaaattcttatcagaagagataaaatcaattttgataattgaatacatttatttttataatttttacaggaggaaacaaaaatggcagcaaaaattttttatcaggaagattgtgatttatctttattggatggaaaaaaaattgcgattatcggatacggtagccagggacatgctcatgcattaaacttaaaagaatctggctgtgatgttatcgttggtctttatgagggaagtaaatcctgggctaaagctgaaaagcagggattaaaagtttatacagcagcagaggctgcaaaacaggctgacatcatcatgatcttaatcaacgatgagaaacaggcaaaactttacaaagaaagtattgagccaaaccttgaagaaggtaatatgttaatgttcgctcatggtttcaacattcacttcggatgtatcgtaccacctgcaaacgttgatgtaacaatgatcgctcctaaggctccaggtcatacagtacgttctgagtacttagcaggaaaaggaacaccttgtctagttgctgtagagcaggattacacaggaaaagctcaggaacttgcattagcttatggtgctggtatcggtggagcaagagcaggtcttcttgaaacaacattcagaacagagacagaaactgacttatttggtgagcaggcagtactttgtggtggtgtttgtgctcttatgcaggctggtttcgaaacactttgcgaagctggttatgacccacgtaacgcatacttcgaatgtatccatgagatgaagttaatcgtagatttaatctaccagtcaggtttcgctggaatgagatattctatctctaatacagctgaatacggtgactacatcacaggtcctaagatcgtaacagctgagacaaagaaagcaatgaaacagattctttctgatattcaggatggtacattcgcaaaagacttcttacttgatatgtctgatgctggatctcaggtacacttcaaagctatgagaaaacttgcttctgagcatccatcagaaaaagttggtgcagatatccgtaagctgtacagctggagtgatgaagaccagttaatcaacaactaatttttgaacatattttaaaagccctaaagccgcttaaatagtggctctagggcttttttctttttctgagaagtactaaaaagatactaggactacctactacctacgaatagaattgtataattatgtaaatttatttagttcaatttagctatatttataacccaattcagacaaagatatgagaatttatgatggttatgccaaaattctttgatttaatatgcttgacaattagagtagcttgaggtatattgtattccactttgacgataaattcattttatgaaaagagaaaaggtgggaaatttatgacattttatcaagagctgcaacttagctcaactggttcaaaagaattgatcaaaaagacaacagacccgaaggaaaagagaaggcacatcctaatttataatgttaaggtataccttgttgtggctttctgctttgctttagtaacgctgtttagcgcagtatttggttctggaaacagtgttgcaggagttgttgttctcttagcattgcttgtattaagacaggcggatttcggaattaaaacaacacatggtcttttgtgtattgcaggaattttcgggattcttatcatagggccgagatttacaaacactttagccccgatacctgcattttttgtaaatcttgtttgtattatgttactgatgattttaggctgccataatgtgatcatgtctaatcattcaacatttgtattaggatatttattattacagggatatgatgttactggagaagagtatagtatgcgagtaataagtttactcattggaatggctatctgcatggcagtattttataagaatcagaggaatcggccatatcgccggacatttcttgatttgttcagagaatttaatcttcattctgcaagaaactggtggtatattcgactgacagtaatggtttctaccgcattactcattatgtctttattaggattaccaagagcgatgtgggcaggaattgcctgtatgtctgtatgtctgccattttccagtgatttagttgcaagggctaaattaagagggccttataatatcttaggttccctcatttttgtggtactttatattgttcttccaaaatcaatgtacccatatatcggaattattggtggaattggagtgggatattctgcaggttacgcgtggcagaccgtgtttaatacctttggtgcgttgtccattgcttctgggttatttggaatgacaggagcggttgtgcttcgtattggagccaatgtatttgcttctatttatacggttcttgtggataaggtgttaaataagatatttgaatggacaacacagatagctccgaaatatgagtcttaaaaaatataatggaaacagaagaaatacattttcatatctaattgaataaattaatctccatcagaaatagaatctttgaaaaaattacaaaaaccccagaatttatggtaaaatagatttaaaaagaaagaggggtggagcatatgattaaagtcttgatgatatgccatggcaatatctgcagatcaccaatggcggaatttattttaaaggatatggtgaaaaaaaagggaatggaggattcgttccttattgcttcctgtgcaacgagcagggaggaaattggtaattctctgcatccgggtgcaagagcgaagcttgatgagatggggatacctcataaaaagcgtgcggcggtacagcttaccaaagaagattatactacctatgattatctgttgtgtatggatcagtggaatatcaataatgtaaagaggatcattggtcatgatccaaagcacaaggtacatctgctattagaatatgcaggggttaagagggatattgcagacccgtggtatactggtaattttgatgtgacttatgatgatattgttcagggatgtgaggcatttcttgaggaattaggtgtataatttgtcgatacaggaaggaaaatatgaagattattatcaaatgtacggacggaatcatgaccggcaaggaatggcgatttaatggaagcggacagattacattaggaagggaaaagggcagcatggttacaactgcacccgaagataacagtatttcaaggcatcagtgtgtgatagatgtcgtgccgccgaatgtttatgtttctgatgcaggaagtacacatggaacttatgtgaatggtcagcttatcggtaagaaaggtcagggaggacagtgcccggtcagagatggtgcatttattggtgtaggttccggtggaagaacagcagtatttcagattcgtattatagaagaagaacgtggaacagtttcaccggattatatagctgacaatatggacaaccactacaatagaagtttcaatggacagaatcttgggaacgattttgcttcttcttttcagtttgtcgttccaagaatcagggatatatttattcgtccagtacatactgcgatagaatttggcaagatgaatagcgcaatactcggaacgacaatgatattaattaatatggctgttttacttgtattagcggttattgttatggcgattgcaaaagataagctatttggttttggtgcctatgtgccgtggggaagaatcatcattggtgtagaacttatggcagcatttagctattttggacttgcagctttaatgcttctttctgcaagagtatttttcagagcggagataacatatgcacagcttttgtcattctatggagtacaggctatatggagcacagcgtatcttcttgtagagagtttcctacttatgattggaacagagggaagcatcatgttatgtctgtttgttttttggataagtattctccatacatttttaattggtattttcagttatggagaagttgtgcatttgtcacccgataagaaaatgtattcttattttgtgtttgtgattttatacattattacatatgcaattattcttgcaattttgggaggcggagtaagggatagtctttttggacttatctaattattcatcatattggtaggattgcctttttaaatgtaattcaacaaggcaatatgattaaaattttctaccctcatagatgtatattccgtttgggggataggaagtctaactaaataaaaaagaaaactctaccatacgatatattagagtaaggaaaggttatatagcagcatatttcctcacaaataatagtagtcgttggtagagtttttttattttaagaggcaaaaagggtcaagttatgaaacggtatggcattgtatgtaaaaatagaagtatgaaaagcacgcatttaagccctttttgcaatgtacgaaaatcttttcaattttattaataaaaattgtttggtttttttcagactattgcaaaaattactataaaatggtatttttatagtaacaattttagcgaataaaaagaaaattaaaaaggagagaaagtatgggatacagagaaagaaataacagccaaaatggtgggtggaacacaggaaataacctgcagtcaggctggaatgccaggaattcttcacaaaatagctggaaccctaataactcgcagtcgggttggaatccgggaaatagtcagcagccaggttggaatccagataattcccagcaaaactggaacaatatgaatccaaacagtcagtggaatcctaatatgggcggaggctatcagggggatccgggaaggaaaaatcgtgggggactgacaaaagaagtaattattgcccttcttatcgcagtagcagccattgtgtttgttgttattttatttgtggttagtggaaaaaagagtagctctcaaaaggacaataacagcacgaaaagttccacccaggcagtagcagaagcaacaacgcaggcagcgacagaggagacacaggctacaacagccgcaacaacacaggcaactgtagcaacaacagctgcaacacaaagtcagaacacgacaacagccgcaatggacaatacgtttattttctcagatagtaattccaggaaacttacaaaagaagaagtacttagattaagtgcatgggatacaaagcttgcgaagaatgagatttatgcccgccataatagaaagtttgataatcagaaaatccaggcatattttgattcgcagcagtggtatcatggaaccgtcgcaccatccgattttgatgaggatgtttttaatgagtatgagaaggccaatgtagagctcttaaagaaagcagaagatggaacactgacagcaagtacatcctcaggaacatccagtacagatgatgggtatattatttcagatagcagtatcagggaacttacagattctgatcttagcggactatctaaaggtaagttaaggatagcaaggaatgagatttatgcccgtcatcacagaaagtttgacagtgcagatctccaaatctattttgataaaaaaagctggtattcaggaacaattgagccatctgattttgatgaaaagaatgagcttagccagatagaaaagaaaaatatcgacttgataaaaaaatatgaataaaaatatttgaaataatctttaattattttaaaatagaaacaaagtaacagacacgaggggaaaaaatatgagaaaaagatttagtttatgtaagaaagtgggagtatttcttcttacagcagtgatgtgtacaagccagctcaatgttcaggcagagaaaaagtatgattttgagacagaatatcaggtggttgccggagcaaacggatattttatcgcgaaaaatcaaaaaggagagtacggtctgcttgatcgtgaaggggaaaaagcggttggttttgactacagtgagatggagtttccgaaagataccatgcagtatcagtacataaaggtaaagcaaaacaaaaactggggaattgtagattatgatgagaatccattagttcctttaaattttgaaaaagtatccgaatacagtaatggaaataccattgcagccggatataacggaaatacaacatatctctatgatttaaagggaaaggaacaaaagaaacagcttacaggttctggaagttattctgttatttcagatactgttttctgggggaaagaagacattcgtaatgagaaggataataccttagtaaagttagaagaaaacagtcttttagataagaagaaaaatagtcttgccgtaaaggttggagatacccactatgcagtacaaaagtatacaacgcagctgacaggtaatttagagacagaccagaatattgaagtgtatgaaaaagatgaaaagacacaggatattcttccagaggaagaatgggtaaaggataaagacagtacagtaaagggaagtcttaaactgattaaagcagtatccgataaaaatatcatagcagatatgcagatggatgatggattcaaagttatttataacattgaagatggacagagcacatcaaaatataaaagcattggcgagttcagggatggaaaagcctttgcggtagatatggataacaacattaagattatagacacatcaggaaaggctatcaataaaaacgatatcgaggttgcagactgtggatgatttttacagatattatgcaccagattttaattttttatatcctaaatctgtttttgcttattccgaggctgatgatgagacaaacagttattatttatcttctgcggatggatcaatgacattagaattttatgaagaagatacttcaggttcagcaaaagaaaatgtaaagaaattttataacaaaacacaaaatgaggttcatgctataaaatatgatcctaaatgggaagatcatcaagtaatagcaggacaatatgtggctaatacaaacgaggcattttattattttataagaaatgagaacgctaaaaattatatttttaagtttcattatgtagatcccgatcttaataacgattataatcaggaagactatattatggaaaccatatatcgaggctgttcttttagtaaagctagtaagccaagaagtttcagaaattttgaagacgaaggaaagaagcaataattatgatgaaaacgataataaaaacgaactatttttctagagtttttttatacggcttgattttttctttgtgtattttcccactttctgtaaaggcaaggcagacatctcccaaaaaagatttatgcatcgtcattgatcccggacacggaggcatccagtccgggacacagagagggacggtagaagaaaagactttgaatttaaaaatcgcgcagtatttaaaagaggcattagaaaagtataaaggggttaccgtatctttaacaagagatggtgactatgatgtgagtcttactgaccgcacgcaatatagcgtagataagaatgcagatcttatggtgagtattcataataatgcaacaggagactgtgcagcttatgataacggttgtacagttcttgcggcaaaagatggctataagcaggaacttgcagatgaggaacaaaaacttgcctgcaatattttaaatgaactatcagcacttggaatagagaaccagggaattttactccgggattccgaggccaatgaaaaatatgagaatggagaactggcagattattatgcaatcatccgcggaggtgtattaaaagatattcctactgttttggtggagcacgcttttgtagatgatgattcagattttgaaaactatttaagcagtgatgcaaagttaaaagcactggcagaagcagacgcaaaagggattgcaagatattatcagctgaccacagaagatgggaagaaagcagaaagtccattagaaaattataaagaaaagattgttcatatcatagatggcaactgtaaacataataaaatcagttacaaaacatattattcatcttcaaaaaaagaaaccgaagagaaatccgctaatacggatactacaactgcaaaggccgaaaaacaggagcagactacggaaaagtctgctccagaggcgaaaacggatgttatctctgagtcagaaagtcaggaaaaaagttcagaagaattctcaaatacagtcgaaaacacttcctctaaatctgtaacaaaacctaaaaaaagagaaagtgttcagacagattctatgatactctttgttctaatagcagcgcttctaatagcactgattttactaggaactttactaaaaaagagaaagaagtagtacagcaatgggaaaataaaaaaaagaataccgatgcgttcttgagcttgcacataaggacacaaatatggtctatttatttataatttcgtaaacgcaatagcctgttcatgccgtaccacacttttataagcatcctttctcatcgaagttaggaaaagatataaaatctctattacagtcgttgcagatacccgtgaaaaacaatagccatcaagaaataacttttcacgggttgccgttgtaatgtgataatcactaagctgtgcagcactcgatttctcgctatttgttatagaaatggtagtagcaccggcacttctggcggcctctaatgcacgaagaacggcggtggattcaccagagtttgaaatagcaataacaacatcatctgccatcatattataagtataaccaatctgtgtctcccagattgtgccggacacagcaggaatcccaatctgatttaacttaaaagccccgtcaatcgcaacgggaatagtattaccaactgcaaaaaattgtaccgtctttgcagtatttaacttgtctaaaatttcatgaagttgtttggtatccatcatagaaactgtttgtgtgatttccgtcactttattggctaaaatatttttcaaagactgaccgatatcattgacagaaatacggttggatacttcttcttcctcttttcccctttcggaaatctcttttgcaagagtaattttaaggtgatgaaaacctttcatatctatttttttacaaaagcgggaaaccgaagcatcactgacaccacatgcctgtgctaattctccaacggtcatgtcaacgactttagcggtatgttgtatgatgtaagtacctatttttctttctgattcaaaaaaagtgtctaaagaggcacagattgtatctaaaactgatttttccattgattttgctcctaattatataatttacacttaactatatcacaaaatggattcaattactatttaattcattaagagacagacgcccgggaagagaaccgataccctatatttgtgactttagtcgcggcggtttaaatgctcgctttatacgctcgcatctaaaccttgctccgaggccacaaatatagggtaacggttctcttcctgggctgtatttggctggattttgattgaattaaataatggttgtggggatttgggggagaaggcagaagtgggcaatggcttcgtctgtagtttgcttaatgaattgaatagtaataaaataattttcttgaaaaatatattgacgaaaattaaatatcgtgatatagtacaattacgaaattgattttcacaaaataaaataaataagaaaatatatttctttacgttttgtgaaagactagcagaaagattcaagattaaaggggagaatgttatgaggatcactgagttactacgaaaaagcagtattgcactgcaagtcgatgtgcagtcaaaagaggagataattgattatcttgtagatttaatcagtcagtcaggaattattccagataaggaagagtacaagcagggtattttattaagagagagtcttggaacaacggcaatcggagatgagattgcgattccacatgcacagttggattcgataatggcaccggggattgcagcgattactgtaaagaatggtgtgaattatgatgcgccagatggacaggatgtaaagctttgttttattattaccgctccaaagacattttattggagcgttagttggctgtctggtactttctttcttaaagaaacctttaccagaaaatgtagaagaaaaaaaagagaaggcattaaaagatataatatatagaaaactatttttgaaaatttattctatataatatgaagagttacgatttatggataaagaataaatgagaaaataaataaaacatgctttaaaacaggtgacagaaaaaggagacagaataatgaacatgaaacaattatgtgccaaagaagcactaaaatatataaaagacggcatgtgtatcggacttggcggtggttctaccataggatatttagcagagtatcttgccaaagaggagagaaaaataacggtagtaactccatctgatgatacagcagaactttgtaaaaacttaggacttatggtattatcactggaaatgacagctcatatcaacattgctttcgatggttgtgatgagcttgataaagagttaaatgcgctgaaagcgaatggcgcgattcatacaaaggaaaaaattattgcatccatggcagaaaaatatgttttgttaattgatgaatctaagttttatgatacattaccgttaaaagattctgtgacattagaagtgattccacagagcagaaactatgtgcaggcacagatagaaaagcttggtggaaaggcagtaatgcgaaagagtggtgccaaagcgggttttgttattagtgataatggaaattatataatggatactgatttttctaatgtagccgcatttgcaggaaaaccagaagaacttcatcagaagttaaagcagcttactggagtggtggagacagcattatttattgatgtggtagcatttgctctttgtgtgtgcggggatgaagtaaaagtcatcgaaaaataatgagatattaagagtagagagtgtttgaaaaagtatttaataatatgcatgtgtaatttacagaaagtatttttcaaatacgctataattcagaataacaaaaagataaaaacaggaaagaatttatatctaatatggtttaaagcaaatgagttgagttataaagaatataaattggcagaaaggaagttgaatatataatgaaaaaattaaactggggaatgcttggaacaggctggattgcccatgagatgggtgaggctttaaaacgtgtcaatggtgagatttatgcctgctgtgcgacaagtatggaaagcgcagaaaaatatgcagaagaatttgatgtaaaaaatgcttacggcagtgcagatgaaatgttcgacgatgagaatattgatattgtttatattgcaacaccgcataattcccattatgaattcttaatgaaggcattacagagtggaaaacacgttttttgtgaaaaggcaattacagtaaatgatacacagcttgaagaagcagtgaaacttgccaaaaaaaagaatcttgttatttgtgacggcatgacattatatcatatgcctgtctttaaaaagatgaaagaaatcgtggacagcggaaagcttggccctgtaaaaatgattcaggtaaactttggaagctgcaaagaatacgatgtgacaaatcgctttttctccaaagaattagccggtggagctttattagatatcggtgtgtatgcgacgagtttttcgagatttttcatgaagagtaaaccaaatagcattctcacaacggcaaattattttgagacaggtgtagatgagacttcaggaatcattcttagaaatccagacggtcagatggcagttatggcacttacgatgcgtgcgaaacagccaaaaaggggtgttgttgcctgtgaggacggatttattgagatttataattatccaagaggagataaggcaactattgtttatactaatgatggtcatacagagacaattgaggcaggagaggcagcctatgcactggattatgaagtagaagatatgcagaactatgtcttaaatggcggaagtgaagaatatctgacttacagccgtgatgttatgagtgtattgacagacattagaaaacagtggggaatgatttacccatttgaatagaaaattgaatgggaaaaagaacaaggaaaggggtgcaggaaagcttgcatctcttttggtatcgcagtataatgaaaaattgtgctgacttgcaacttgaaatagataaaaaatgtataaaaaataatgttgtcattgtatagtatgtacgcaaatctattatttactttgtaaagtaggaagatacaggaaaaagaggagaaaagatatggaaaagaaatatttattttttgatattgatggaacgttgacagaccgtgcaacgggagagattgttccaagcgcaaaagaagtgttacagcgattagaagagaacgggcattttgtggcaatcgcaactggaagggcacattacaaggcagaaaactttacattggctatggctggtgtcttgtcatggatgatacaaaagatgtttatatgaaagatactttatttcgaaaaatctcgtaggtcatcttcgttttgaaccagaatatctgatgttccagccggataataagcgaggcggtatcttaaatatgatggaattaaaaaggcttgtgaacattttggatggatttgataagataaatcagagggtaaacaggaattttacataataaattgtagatatacacaaccttcacaacccgctttacagaaagcatttttcaaacacgctctagtttaaattaagttagagtagtttatatataaaaccaacaataataaataaagaaaaataatgcaaggaaataataaaggaatatcacataaatgacagaattaataaaacaaaaaaaacaggtgcccgaaaggctatatagtaacaaaaagttagcggcactgctcattccattggcgttagaccagcttttgaactcttttatgggaacgattgatacattagttgtcagcaatcttggttccgcagcgatttctgcggtatctctggttgactctattaatatattgattgtacaggcgttttttgcgctcgcttccggcggaacagttgtctgctcacattatcttggatgtaaaagtaaagatcatgcgaaggaagcggcaaggcagcttgtatttgtaactctgatgttatctctgataatcggagcaatctgtcttgtatttaatcagcagattttaaatctgatttttggaaaagtagaaaaggatgttatggcaggcgcaaaacaatatttcttttactctgtgctatcatatccgtttatcgcactttataacgatggggcatgcattttgcgggcacagaataatagtaagtttccgatgcagatttccattgtatctaactttttgaatgcatttttagatgtaatttttgtgtgggtatttcattggggcgttgccggttccgcgattgcgacagccggttctcgtttttttagtatgagtatcgtattgtggaaacttagaaacccatccctggaaattccattcagaaattatttttcgattcgtccaaactggagagagattaagaagattttaaatattggaattccttcgggaattgaaaacagcatgtttcagtttgggaagctggcaattcagtctaccgtttcactgatgggaacggcggcgattgcagcacagggaatgacgaatgttatcgagaacttaaatggtattcttgctataggtatcggtattggactgatgactgttgtaggagaaacattaggagcgggaagaaaggaagaagccgtctattatataaagaaattttgtattattgcagaaataactctggcggtatcctgtctgattttttatcttctggtacggccaattacctactttggaggaatggaaccggaaagcgcaaagttatgcatctacatggtaacgtggattagtattgtaaagccgcttatctggatcatggcatttattccggcatatggattacgtgcggcaggggatgtaaagttttctatgacagtttctgtgctatgtatgtggttttgcagagtaagccttgttattttccttgcaagagcctatcatatgggtccgatggcggtatggattggtatgtttgtggactggggtgttcgaaatataatctttacgattcgctttagaagccggcaatggctgaatcatgaagtaatttgattcacaggcaagggggagacgccctcaaaaagagaaaacagaccatatttgtggccgaatgcgctattttataaaattatataaagtgttttcaaacataatttagtatttttcatgtgagaataattctcatataaaaatgttgacttttcctagatggttatgatattcttacgtcagttagtaatccctaactaaaatgtgagataattcatgtgatgctcttttcgtcccattgagccgggacgagggagatccatgggaaaggattgacgtaaaagatgttacatttagaaattgaaaaagtagtaggcagagagattattgattccagaggaaatccaacagttgaggcagaagtatatttagcagacgggactgttgggcgtggagcagccccgagtggtgcttctactggagagttcgaagcattggagcttagagatggaaataaagacagatttggaggcaaaggagtttctaaagctgtaggaaatattaatacaacaatcaatgaagcattaaaggggattgatgcatccgatatttatgcagtagacggtgcaatgcttgcggcagatggcacaaaagataaatctaatcttggagcaaatgctattttagcggtttctattgcagcagttcgtgcagctgccactgcattacagattccattatatcgtttactcggcggagtgaatggaaacagacttcctgtaccaatgatgaatattttaaatggtggtgctcatgccgcaaacactgtagacgtacaggaattcatgattatgccggcaggagcaccaagcttcaaagagggacttcgctggtgtactgaagtgttccacgcattagcagcacttttaaaagaaagaggattagcaacttctgttggtgatgaaggtggatttgcaccagacctcggaagtgatgaagaagccatcgagtgtattcttgaagcagtagaaaaagctggttataaaccaggagaagactttgtattagcaatggatgccgcttctagtgagtggaagagtgctacaaaaggagaatatctccttccaaagagcggaagaaagtttacatctgcagagttaattgagcattggaaacagctttgcgagaaatatccaatctattctatcgaagatggattggatgaagaagactgggaaggctggcagcagcttacaaaagaacttggagatacagtacagttagtcggtgatgatttatttgttacaaacacagagagactttctaagggaatcaagcgtgggtgtggtaactccattcttatcaagttaaaccaaattggttccgtatctgagactcttgaagctatcaagatggctcataatgcaggatatactgctgtaacttctcatcgttctggtgagacagaagatacaacaatcgcagatttggcagtagctttaaatacctgtcagattaagacaggtgcaccaagccgaagcgaacgtgttgcaaaatacaaccagttattaagaatcgaagaacagttaggcaatgccgctgtttatccgggaaagggagcatttcatatttcccgttagttagcttattattcaattacatatgccaaatagataaataataagaagtgaaaaagccattttgtccgataacagaaaaactgttgtcctgcagaatggcttttttattgttatgtgacttgtaatatttataatgaatacggcgatatgtgaacatgaagataagagatttatagaatattttcagagataaatttttgtagaataaaaatactttatactacttgtgtagtaggcaacaaaaaaacaacgtgatataataaaacaagaatataataaaagaagcggaggtgcttgtttatgaaatttttaatcaaacaaagagtattttcctggtcagatacctttgatatatacgatgaatatgagaataagaaatattttgtacaagcggaatttttatcgttggggcatcgcctgcatgtatatgatatgaatggacatgaggttgggctgattaaggagaaggttcttacctttttgccggagtttgaagtgatgataggcgggcattcctgcggtattataaaaaagaagtttaccttttttcaccctcagtatgaacttgattataatggctggcatgtggaaggagatttcctttcctggaattatgatgtatatgaagcctgtagtgcggttatacatattacaaaggaacctttacattggggagatacttatgtgattgatttccttgatccaaaggatgaactgatggggctgatgcttgttcttgcaattgatgcagcaaactgtacgaataattaaaaaggcagaaatacatttttataggcaggacattataccgataaagaaaaaggaatttctaaaagtaaagttaatatagtaaatttgttttgtgaaaaagtatttgagtaaacattgtttaagggggaaatggatgctatgaaagtcaaaagaattgccattgttaccggagcaactggcggacttggacgtgaatttgtccgtcttttattaaaagaaaaaaatatagacgagatatgggcattagcaagaaatgagaaaaagcttgggcgtctgaaagagaagtttggtaaaaaagtaaaaatatattcctttgatttatcgagtgttcgtcagatacaatgttttgaagaagaactaaagcaggaggcgcagcggcggaaattagagatttcttatctgattaataatgcaggctttgcaaaattttgttcttatggagatttaagtattgaggaatctttaaatatgattcatgtgaacattgatgcagttgtggcgatgggacttgtctgcattccttatatgaaaaagggcagccatcttattaatattgcttcgcaggcatcatttcagccacttccgtaccagaatatctatagttcaacaaagtcctttgtcagaaattattctagagcgttaaatgtggaattgaaggaaaagggtatttatgttactgcagtttgtcctggctggataaaaacagacctttataagagagcagaaattggagcaaggaaggcaacaactcgctatgtgggtatggtaactccagataaggtggcaaaaaaagctttaaaagatgcgaaaaagggcaaagatatttctatttacagtctttttacgaagatatcccatgtagcggcaaagcttcttccgcagcgtataatgatgaaaatctggttaagacagcagcatttagataattgaatagagttgtcgataatgtctatttacaaatcaccaatatctgctataatgatagggcttatagttgagagagaattatttttggactcagcgaaagtacaggaggaaaaagtatgtttagttttatgaatcccggaaagagcaaaccggcgaaaaagggattaaagattatcattgtaggctgtggtaaggttggaacaacgctagtagaacagcttagtaaagagggacatgacattatcattattgacaagaatgcgaaaaaagtacaggaaatcgcgaatatatacgacattatgggtatcgtagggaatggtgccagttacagcgtgcagatggatgcaggaattgaagatacggatcttatcatctctgtgacagaatcggatgagctgaaccttctttgttgtacagtagcaaaacaggttggtgactgtgcagcgattgccagagtccgcaccccggattacagcaaagaggcgggataccttcgagaaaagttaggtcttgcgatgattattaatccagagcttgaagcagcgagagaggcagcaaggattttattccttccatctgcgttagaagttaactcttttgcacacggtcaggcggaattgattaagtttgcaattcctgcaggaaatatattagatgggcttcagatagcagagctccgtggaaagatagaaacgaatattcttgtatgcggtgtagagagagatggagaagtacatattccttctggtgattttatattacagcagggagatgttatttctgttgttgcttcccgcaaaattgcaagagaattcctttctcatatcggatttgagacaaagcaggtaaagaatacgatgattatcggcggaggtaaggcagcgtattatcttgcaaagaaccttttagatgttggaattgatgtaaagattatagagagcaataaggagcggtgtgaggaattatccattcttcttccaaaagcaattattatcaacggtgatggaaccgatcaggaattattaagggaagagggacttccttatgtagagtcttttgttccacttaccggaattgatgaagagaatattcttttaacattgcatacaagacaagtttccaaggcaaaagtaattacaaagattaatcgtattaattttaaggatgttattgcaaagcttgatttaggaagcgtgatttatccaagatatattacatcagaggcaattattgcttatgtacgtgcgagacaagcttctcttgacagtaatattgaaactctgtaccatatgtttgaccatcgtgttgaggcgattgaattcagagtgtatgaagaatctgccgtaacaaatattccgttaaaagatttagcgctgaagaaagatttgcttttttgttttatcaatcgaaatggtgcgattattcttccaaatggtcaggattccattcaggtaggggatacggttatggtcgtaaccacacatacaggctttaatgacttaagagatattttggcataagtacggaggacaatatgaacagttcgattattcgttttgtattaggatatgtattgaagatggaagcagtgttaatgcttcttccttgtattgttgctgtgctctaccgggagcagacaggttttgcctatcttttagtggcagcggtatctatggcatttggtacattgatgacgataaagaaacccaaaagtcatgtgttttatttaaaagagggctgtgtagcaacggctttaagctggatatttttaagtttttttggtgcactgccattctggatttctggagaaattccatctttgatcgatgctttatttgagacagtttctggttttacgacaaccggttcaagtattttagcagatgtggaagcactttctcattgtgctttattctggagaagctttactcactggattggcggtatgggagtactggtattccttcttgcggttattccgttaagtggaggttctcatattaacttaatgcgtgcagaaagtccgggaccatctgtaggaaagcttgtgccaaagattaaatacactgcacagattctctatattatttattttggaatgacaattgtagagattgtgcttcttcttatcagcaggatgcctgcatttgatgcgattactctgtcgtttggaacggcaggtaccggtggctttggtataaagggagacagtcttgccagttatacggcactgcagcagtggattgtcactatatttatgattttatttggagtaaacttcaacgcttattatttgattttatttagaaagttcaaaaaagcacttcaaatggaggaagtacgcgcatactttgctattattttcgtggcaacagcaattattaccggtagtttagtcggaggaaatatgcagttttttgatgcacttcgtcatgccgcattccaagtgggttctatcattacaacaacaggatatgcaaccgtcaattttgatgcttggtcgcagacttgccgggcaattcttgtccttttgatgtttgtgggagcctgtgcaggaagtactggtggaggaataaaagtatctcgttttattgttatggtaaagacaatgattaaggaactcaattcctacatccatccaaagagtgtaaagaagattaaaatggatgacaaaccaatagagcatgaagtagtacgctccattaatgtatattttattacctttatgattatttttgtcgcttcagtcatagccatttcatttgaaggccatgatcttgtaacgaactttactgctatagcagcgacaatcaacaatattggtccggggcttagtatggttggtccggactgtaactttggattcttcagtgatttttccaagcttgttattatttttgatatgcttgcaggaagactggaattattcccgttacttattttattccatccagcgatttggaaggaattgtttacgcagaaaatcacgatgaggaggaagaagaaattctgagttgctgcaggcaaggcaggcaccctccgggaataaaagaaactatatttgtgactttagtcgcggcagtttgaatacttgcttatgcgctcgtatctaaaccttgctccgaggtcacaaatatagtttctttaatctttccaacatatttttcgagcgttcatctgcaaatccctctccaactaattccccaaattttcaataaacaaaattcaagaaaataaattataattataatcttcagaaagtaagagactttttgttcgttttgttattccaaaccggaaagcagaaaaatatctatgtttacttttggtaaagtcaatagtggattttattgcctttttataaaagttgaacaaaaatgtagggggttattgataggcatatgaaataagagttagttattgaaaatatttctcaataaatgcattgacttctaattataattagggtatactaactttcgtagaaaagaaattcatacagatgtactaggtgattatcagatacactgtcggaaaatttgctttagaaaaggagatgataatatgccactgtctatggtgaaagcaggagaaccaaacgtcattaaaaaggtaggaggaaagtcagaaacgaaaaagtttcttgaaaaccttggcttcgttgttggtggtctggtgaccgtaatatcagaaatcaatggcagtctcattgtgaatgtcaaagattccagagttgctattggaaaagatatggctaataaaatccttgtttaaagcaagttttttgttccgatgaataagtatgaataaaaagggagaataaagacatgaaaacattaaaagaagtcgctgttggtcagacagtaacagtgaagaagctttctggtgccggtcctgtgaaacgtcgtattatggacatgggaatcacaaaaggtgttgaagtttatgtaagaaaggttgctcctcttggtgatcctgtagaggtaacagtaagaggttacgagttgtctcttagaagagcagatgcagagatgattgaggtagaataatcaattttttttactcttttagttagtacttgctaatatatattagcagttgcgcgttaatgttagtaatgacatctaaagataagcaataataaactttagttgtttttttaaaacattagtaagtttgaaatttgaggaaaaggagaaaaaaatgtcagtaaaaattgcgttagcaggtaacccaaactgcggtaaaacgacattatttaatgccctgacaggttctaaccagtttgttggtaactggccgggtgttactgtagagaaaaaggaaggaaagttaaagggacataaagatgttgtcatcatggatttaccaggtatctattccctttctccatatacattagaggaggtagttgcaagaaattatctcattggagaaagaccagatgcaatcatcaacattgtagatggtacgaacatcgagcgtaacctttacttatccacacagattatggaacttggtattccagtaatcatggcaatcaacatgatggacctcttagagaaatctggagagaagattgacattgcaaaacttggtaaagaccttgggtgtgaagttgttgagatttccgcattaaaaggtactggaatcaagaaggcagcagaaaaggcagttgcattagcacagtctaagaagtctgcagaagttgtacatagctttgataagaaggtagaagatgcaattgatgctgtaaaggtaatgttgggttctcaggttccagaagaacagaaacgtttcttcgcaatcaagcttcttgaaagagatgataagattgtagaacagttaaatacagttccagatgtttctaatgagattaaagctcttgaagatgcattcgatgatgatacagaaagtatcattactaacgaaagatatgtatacatttcttccgtagtagcagatagctgcaagaagaatggagctaagaagcttacaacatctgataagattgaccgtatcgtaacaaaccgctggcttgcacttccaatttttgcggttgttatgttcattgtttattatgtatccgtatctacggtaggtgactgggcaacgacctgggcaaatgatggagtatttggtgacggatggcatctctttggtattaagtctcttttcatccctagtgttcctagcattgtagaaggtgctttaaatgctgttggatgtgcagactggttatctggattaattcttgatggtattgttgctggtgttggtgctgtacttggtttcgtacctcagatgctcgtattatttattttccttgcattcttagagtcttgtggttacatggccagagttgcattcattatggatagaattttccgtaagtttggtctttctggtaaatctttcatcccaatgttaattggtacaggatgtggtgttcctggtgttatggcatccagaacaattgagaatgaccgcgatcgaaaaatgacaattatgacaaccactttcattccttgtggagcaaaacttccgattatcgcattaatcgcaggtgcgcttttcaacggagcatggtgggttgcaccaagcgcatattttgttggtattgcagcaatcatttgctctggtattattttaaagaaaacaaaaatgtttgcaggagagcctgcaccgttcgttatggaacttccagcttatcatatgccaactgtttctaacgtattaagaagtatgtgggaaagagcatggtctttcatcaaaaaagcaggaacaatcattcttttatctacaatcatcttatggttccttatgaactttggatgggttgacggaaactttggaatgcttgaggcagaacagttaaatgacagtattttagcaactatcggtaatgtaatcgctccaatctttgcacctcttggatggggagactggaagatggcagtagcagccgttactggattaatcgcaaaagagaacgtagtaggtacattcggtattctcttcggatttgcagaagttgcagaagatggtagcgaattctggggacagcttgctaacagcttaccagcagtagcagcttactctttcttagtgttcaacttactttgtgcgccatgtttcgcagctatgggtgctatcaagagagagatgaacaacattaaatggttcttctttgcaattggataccagtgcttacttgcttatgtagtaggtctttgcatttatcaggttggtacattaatcacagcaggtacattcggaattggtacagtagtagcatttgtacttatcatcggatttatctaccttctgttcagaccttataaagaaagtaatacattaaatgttaatgtaaaaagcgtagcaaaggcaaaataattaaaaagattatatatctgttcagaattatgatttgtgattctgaacagatgatcaatagtttacgataattgatattttatatagaagggaagtgtatgagatgggaacaataattgtgggacttatccttgttttaatcgtttcccttattattcgaagcatggtaaaagataagaaaagcggaaagtcaattcaatgcggaggaagctgctcacattgtgcgggacattgctctgccccttgtgacactccttctaacagagattaagtataactattccgaatagttgcgattagattagataaaagaaagaagtgtggatatgctgcaaaaagctaatcagaatcttccgattaatgatgtgggaattcacagaacacagatgcagaaagagataatattgcaaaagttaaaagagcgtggctgtcggattaccagacagagaaagatgcttttagatgtgattttgaatgaagactgctccagttgcaaagaaatttactataaagcatctatgaaggattctggaatcggaacagctacagtataccgcatgattaatattctggaagaaatcggtgcattaagtcgaaagaacatgtataagattgcgtgtggaccggaatgtgaagtcaaagacgcctgtgtgattgaattcgatgatgatacgattattgaactttccggcaaaagctggaatcaggtagtgcagttagggttaagagcctgtggttactccagcggtcataagattaagagtgtaactgcgaagtcctgtgaattttcaagataaaaataaaaaatatatgccattatagaataaccctggaagacttaaatcttctgggggttatttattttgataaaaaaataacaatttaataagccagatatgtggcgtgaatgataaaaatacagaaaaaatacaatatctagtactttcttagaaaacaaaaaaatcttcaaaaaatgcttgacgcaactctattgttatgataatataatatgcgttgcacatgagaaactcatttttaaaagaaaaatgacaagaatcttaaaagaaaatgaaaaaacttcttgacagattgagaatcatgtgataatatataaaagttcacatttgacagcgagaacggacttcttaaaaagaagaaaaagttcttgaaaaaagttcttgacaaagatatgagaatgtgataatataattaagcgttttcgaaagaaaacacaaaaccttgataactgaataacaaaacaaccttgaacgttaattcaaatttcattcgggttttcctgagagtgatgtctgcaggaaagtccatggaacagaacgaaagttcaaaacctaaataaacagtaatgacaggaaaagaaccagtggttctggaccttgatctgacatcttgaacattttatttgagagtttgatcctggctcaggatgaacgctggcggcgtgcctaacacatgcaagtcgaacgaagcaccttttgagattcttcggatgatcgatcggtgactgagtggcggacgggtgagtaacgcgtgggtaacctgccctgtacagggggataacagctggaaacggctgctaataccgcataagcgcacgaggagacatctcctagtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagtgtggggagcaaacaggattagataccctggtagtccacgccgtaaacgatgaatactaggtgtcggggccgtataggcttcggtgccgccgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccactccgtaatgggagttttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtcgtaacaaggtagccgtatcggaaggtgcggctggatcacctcctttctaaggaagacaagtagagagttgttttgttattcagttaccaagtgaaaacttgataacgcccttccgggtggcgatgcgctcaggggacacacccgttcccatcccgaacacgatggttaagacctgagcggccgatggtactatgctggagacggcatgggagagcaggtggctgcccggttccttaaaagatcttttgattgattttgagggaaccaagcaggtgtggcaatacggaagtggaagatgtaccttgaaaactgcacacagatagtttttcttaaaagaaaagcgacatcagatttctatgataagaaagaattgagactaaatcaattctcccaatagcaagtcgaaagacgaaacatgagttttaactcatacgccgaatgttctctacgctaggaggaacaggaggcagccatttcttaggaaatggacatacaaaggtcaagcgaagaagggcgcagggcggatgccttggcactgagagccgatgaaagacgtgataagctgcgataagcttcggggaggagcaaatatcctttgatccggagatctctgaatggggaaacccggctgtatggactacagtcatccataagtgaatccatagcttatggaagggaacccggggaactgaaacatctaagtacccggaggaagagaaagaaacatcgattccgtaagtagcggcgagcgaacgcggaagagcccaaaccgtgatgcgtgcatcgcggggttcggactgcataagggattcagtaacgacaggagaacggctttggaacagccggccaagagggtgagagccccgtatccgaagtcagagctgacccggcaggatccagagtaccacgggacacgggaaaccctgtgggaacgagcggagaccactccgtaaggctaaatactactcagtgaccgatagcgtatagtactgtgaaggaaaggtgaaaagaaccccgggaggggagtgaaagagaacctgaaaccctgtgtctacaagctgtggaagtacttctcaggtacgaccgcgtactttttgtagaacggtccggcgagctgcgggtactggcaaggttaagcacttcaggtgcggagccgcagggaaaccaagtcttaagagggcgttttagtcagtacgtgcaggcccgaaaccgggtgacctatccatgtccaggttgaagccgccgtaaaaggcgatggaggaccgaacccacatccgttgaaaagggtggggatgaggtgtggatagcggagaaattccaatcgaacccggagatagctggttctcctcgaaatagctttagggctagcctcatacaagtctgccggaggtagagcactgaatttccgcgggggcgtcaaagcctaccaaagaatatcaaactccgaatgccggacagatggtgtatgggagtcagactgtacgagataagttggacagtcaaaagggaaagagcccagaccgccggctaaggtcccaaagtgggtgttaagtggaaaaggatgtgggatctctaagacaaccaggatgttggctcagaagcagccattcattaaaagagtgcgtaacagctcactggtcgagaggtcctgcgccgaaaatgtccggggctgaaacaccacaccgaagccgcggaacccgtaagggttggtagaggagcattcttaggggagcgaagcattaccggaaggggatgtggactgctaagaagagagaatgccggaatgagtagcgagagcaaggtgagaatccttgcggccgaatatccaaggtttccagagtaaagctgatctgctctgggtaagtcggggcctaaggagaggcagagatgcgtatccgatggacagcaggtttaagattcctgcaccccttgttatcagaactgcggggacacgggaagggaagcagagccgggaatggaaagcccggtgcaagcgaaggagtcgcagggttggaaaatccgccctgcataagacgaaggcgtgatgcggagcgaaatgaagtagtgaagctgcggccccttcctgtcgagaaaagccgctatcgtgtagcaagggcccgtaccgtaaaccgacacaggtggatgaggagaggatcctaaggccggcgggagaagtgttgttaaggaactcggcaaaatgactccgtaacttcgggagaaggagtgctgcgcaagcagccgcagagaaatggcccaagcaactgtttagcaaaaacacaggtctatgcgaaaccggaaggtgaggtatatgggctgacgcctgcccggtgctggaaggttaaggggagagcttagcgtgagcgaaggtttgaacttaagccccagtaaacggcggccgtaactataacggtcctaaggtagcgaaattccttgtcgggtaagttccgacccgcacgaaaggcgtaatgatttgggcactgtctcaacaacacacccggtgaaattgaaataccagtgaagatgctggttacccgcgccaggacggaaagaccccatggagctttactccagcctgatactgggattcggtattgcatgtacaggataggtgggaggctaagaactcatggcgccagccgtgagggagccgatgttgggataccacccctgcagtactgggtttctaacctgcgcccgtgacccgggcgggggacaatgtcaggcggggagtttgactggggcggtcgcctccgaaagggtatcggaggcgctcaaaggtctcctcaggatggttggaaaccatccagagagtgcaaaggcagaaggaggcttgactgcgacaccgacgggtggagcaggtacgaaagtaggacttagtgatccggtggcataaagtgggattgccatcgctcaacggataaaagctaccctggggataacaggcttatcactcccaagagttcacatcgacggagtggtttggcacctcgatgtcggctcatcgcatcctggagctggagcaggttccaagggttgggctgttcgcccattaaagcggtacgcgagctgggttcagaacgtcgtgagacagttcggtccctatccggcgcgggcgcaggatatctgagaggagctgtccttagtacgagaggaccgggatggaccgtccgctggtggaccggttgtcatgccaatggcacggccgggtagccaagacgggaagggataaacgctgaaggcatctaagcgtgaagcccccctcaagatgagatatccatactcgaaagagtgagagaccccttagagacgatgaggtagatagggcagagatggaagtgcagcgatgcatggagttgactgttactaatcggtcgaaagcttgaccttagtaagttattggaatagaagaagatagtttgtgtgtggttttgaaggtatatcctttaataaatattcctcgatagctcagtcggtagagcacgcggctgttaaccgcgctgtcgtaggttcaagtcctactcggggagttagattaaagcaacaaagttaagtagctttgttgctttttttagtatatttgttataattataatattgccttttaaaaaatataaatataaatttcaaagtaatatttgtgaggatgttagaaataccctaaaaaggtatgagaatgactaaaacagtcaaaacagaaggctccgttttttatcaatggagagttcaatcataacataaaatgctgctattatattaattcacaaaagaaagtttatttaaggagaaatacatataatgaaaaaaataggaatcatgacagatagtcatagcggaatacttacagaagaagcagaaaaattaggaatcaaagttcttccaatgccattttatattgatgatgaattatatttagaaggagtagatttatcaagagaagaattttacgaaaaacttcgtcagggagttaatgtatctacctcacagccatctccacaggaagtaatggaaacatgggatgatatgttaaaagaatatgaaacacttatctacattccaatcagtagtggattaagtggttcctgcatgaccgcacagggattagcacaggatgaagaatatgaaggaaaggtttttgtagtagataatggccatgtttccacacctcttcatcgaagtgttcttgatgcagtggagatggcagaagcaggctattctgccgtagagattaagaagattttagaagaaacaaaagaacagatggtaatttacgtaggtcttagtaccttagaatacttgaaaaagggaggaagaatcagctccacatctgctttacttgcaaacgtattaaatattaaacctgttatgaaatttggaacaggagtattagatgtatatcagaaatgtcgtggaatgaaaaagtcacgtaaagcaatgattgatgccatgaaaaatgaattagagacgacatttcatgatgcgtataaagctggaaaagtatatttaatggcagcttcaagcagttcagaagaagttacaaaagaatgggtagaacagattaaagaagcatttcctggaatggaagtaatgagtgattacctatcatttggactttcctgtcatatcggtcccgacggactcggaatcggctgcacatgcaagccggtgtaattgctatttaattcattaagaaccaacagacgaagccattacccccaataaggcatatttgtggcaatggcttctgtgctgtggctggagaaaatgaattaaacagggggagaaaattgggggggggacagaagccgatgtattctgcttactctattctccccagcatagccggagattagcttttcattcagcaatatcccctacgccatttaaaataagtctcgggcgatacggaaattctttcacagtctctcttgtggataccccagagagtacgagtgcagtatcaagtcctgtttcaatgccggcgataatatctgtatccatacggtcaccaatcatgacggcttcagaggaatgtactcctaaaatctgtaagccagtacgcatcattaacggatttggtttgccaacgtagtaagcttttttaccggtagttgcctcgattggggcaacgaaagcgcggcatgcaggagcgattccaccttcaatcgggccggtaatatctgtattggttgcaattaatctcgcacctttgtttacaagattcatagcagtaataatgtgctcataaccgtaagtaacggtttctccaacgacaacataatctggatcgacatcattaattgtaatacctgcatcgtataatgcgttatatagaccgtgatctccgatgacgtaagcgctgcatcccggagcttgattttgtaaaaacttggcggttgctaatgcacttgtataaaaatgttcttccccaatctctaatcccatccgatataatttattctgtaattcttttggtgagcggctgctggcattcgtaaggaaaagaaattgtttttcttctttttgcagccattctacgaattcttttaccccaggcagaagttggtttccgtggtagataacaccgtccatatcacatataaagcctttttttgatcttaaactttccataattattatctccttttatctgtcagaattttaaatacgtccgaaaagattcccattttataaattattcaaagtgtttttattataatagaaatctgcgttttaaaatatatttgccgaatacgatttcattgtagcgaatttttttattattgtaaagtaaaaagagaagatacacaattattttttgaattttttacaaaaaatatacataacgaacaaatagtctaataattcggaaaacctgtatatttttttgaagaagactaaataacagtcgcttcttaaaaaacgaaatatattttcaatgaatatactttttgtatttagtgatactggtacaagtaaaaaacaaaatgtgtttaaaaaatcattcatgcaatcttccacaaattgtaatgtacatcttacagaaagcatttttcaaacacactctagaacatgaaaatgcaacaaatttcaaattggaggggtaaaaatgaaagcggtaagaatgtatgcaccaagagatttaagagtagaagaagtagatattccttcttatgaagcggatgaatgtttgattaaagtaatggctgttggcgtttgcggttctgatataccaagagtaaatcagtacggagctcatgtttctccaattattgtaggacatgaatttagcggtcagattgtaaaaacaggagataaggtaacaaagtttaaggcaggagaccgggtaacttgtccacctcttattccttgttttaagtgtaaatattgtgagatggtgaatattcactttgtgaagactacgattattatggttcaagaagagatggtgcatttgcacaatatatcgcagtaaaggaaggaaatcttctgaaagtcgatgacaaagtttcttatgaagatgcatttaaagtatggagacagatttataagaatcttgcaatagatgcttatgatatgatcgcagaatttcaggaaaaacatcgttagataacaaatgcatctgtattagaaaatagcaacacaagttagactacataaaaggggaagaaacaatgacaaaacaggaaattttaacacatattgaccatactcagttaaaagcattttgtacatgggaagacattaaaaagctttgcgatgaggcaatcaaatataataccgcttctgtatgcattccgccatcttatattgaaagaatcaaggaaacttacggcgataaaattaatatctgtactgtaatcggatttcctctcggctacaataccacagaaacaaaggtatttgaagtaaaagatgccattgcaaagggatgcagtgaagtagatatggttattaatatcggccatgtaaaaaatggcgactttgataaagtagaagcagaaatcaaggctttaaaagaagctgctggtgacaagattcttaaagtaatcattgaaacatgctacctcacagatgatgaaaaagtaaaactttgtcagtgtgttacaaatgcgaaagcagattatatcaaaatttttactggttttggaactggcggagcaacgattgaggatatccgcttattcgcacaaaatatcggctcggatgtaaaaatgaaagcggcaggaggtgtaaagagcagagaagatcttgaaatattcttagaggcaggatgtgacagaatcggaacaagttctgctgtaaaaatgttagaagaaaattaaaaaacttctacgattacagacttccagtgttatgttttgttactatcttatgaaaaaaatggagcatcgcgattgctgttggaattaataagatagatgctataatcggagccctcgagcaggatttatgaatgttctttataccgatgaaaaaacggcaagagagatattaaataggaatttgctggattgagtaaacagacgaagtcaggagagatcgaagtaattcggaaaattaaatctttcaggattgacacaagattaataagaaaaaagagtatattatcggtgtactattaccgataatccgttctccacagaaagccaaaaccttctggcgattcctcaaattactctaacaataaatagcaattttccctcccacagccaaagcacagcccccgaagagagtctagcccctatatctgtggcctcggagcaaggtttggatgcgagcacttaaagcgagcattcaaaccgccgcgactaaagtcacaaatataggatagactggtatgctcccttttaggtagacagttaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattcccataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaaggcttctgcgtgcggaaaaaagacgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaacgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaggcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccgaccgggcaacacaaaaattttatatttttttaattgtctacttgacgggatgcacaccagactctcttcgggggcgtctttttgcctgcggcaaattcctatttaacaatcactcattgtttttcctgctccagttaatccctcgaagtcttttacaaagtcatcaacagcggaggtgattgcctgattttttacaagtccttcaataatatctggagcgattgtggaagctccgattccgtattcgcataattcaagtacctgctgggagtttttgaagcttgcagcaagaacttctgtttttaagttattgtttttgaaaatatcatgaatctgttttgctacctgaatgccgttgaatcccatattgtcgatacggtttacatatggagctgcgtaggatgcaccgcattttgcagcaagataagcctgcattggagtatagatagcagtagcagtaatgttgatattttctttggcaagagctttcattgccttgaaaccttccgggatagatggaacttttacataagtattggcacctaattcttttacgatacggtgtgcgtcatctaccataccgtctgcatctttggctacaacctgtacatgaagttcagcttcctcgccgataaagctgcggatttcttttaatacttcaaaaggctgtctgccacttttggcaaggatagatgggtttgttgtcactccatctacaggatagtattcatagatttttttaataaggtcaatgtgtgcatcgtcaatgattaatttcatggtaatattcctttcttagataatttgtttggtagatttctctatataatttttattaattctttaattagtttgataattgctttaagatagtcaacaatccccaatgattgagaatcatggaaatacacattattaataaagattataaagcctgttctgttcttccaataatatcgtcctgtgtctttttagaaagtacattgaagaaggcactgtatccggcaacacgtacaatgaggtctttatgtttttccggatgtttctgtgcgtcaatcaatgtttctttagaaacgatattgtactgtacatgatagccgtgtaagcgattgaagaatgtacgaattaacatttctaatttctgcttattttcttcggtagataacatctgtggtgtcattttctgattaagaagaacgccgccggtaattttttctgttggaagcttggaaacagttttgaaaatagcagtagggccgtttttatctgcattatgagcaggactacagccctctgctaacggttcaaatgcatttcttccgtctggagtagcgatagttcccattccctggcctacattggcactgatggaagaagttccgccataacggattccgccaatcggaccacgctggtagcgagtatttggatattttttaatctcatctaaataagaatcatacgcctctacaaccagattgtctacataatcgttgtcatttccgtattttggagcctcctctataagcatttcctgaatctttttattttcaggtgactggaagttatcaaggattgcatcccagagctgctgttttgtgatttttttctcttcgtaaacaagctttttgatggcagcgagagaatctgccatatttgcgattccaacctgaagtccggaaatgaaatcataaacggcaccaccttctttgattgttttgccgcgaccaatacagtcatcagtaagggcagaacataaaacatctgggacatctctttcggaagctttgtcaatggcattttctacaataacactgtagcgagtcatttcacgaaccgtcctatcccatgcggctaataagtcttcgtaagtttccatctctgtaaaataaccatagccttttgtaaaacgctttttgctggtaaggtcaacaccgttattcatggcacaaagaagaactcttgggaagttaatataagacataccagtacaacggtaaccccatttgcccggaacagctgtttccacacagcctatagcactatagttataagcgtcttcttcttttacaccccagttaataaaggaaggaatgataatttcatcattatttaatgcaggcataccaaaaccaagcttcataacttcaatacactcatcaaaaaactttttatttaagtttgcatggtagcgaacggttaagtttggctgggttaatcttgtctgtgcgactgatttaagaaccgtaaaacttaattcatttaccgcatctttcttatcggttgtctgtccgccgattgtaacattctgatacattggggaaccggcagaacttaatgtatgcgcctgggaacggactttatttaccgttaaagtcttaatccataaacaggtaagtaattctaatgcagattcttcgctaagactgccattttccatatctttcttataatatggatacatatactggtcaaaacgaccataacttaaagaatgtccgttagattcaatttgtaaaataagctgaataaaccagactgcctgtactgcttcgcggaaagaggaagcaggttcataaggaactttggcacaaattctgctgatttctaataattcttcttttcttttcgcatctgtctcagtaagtgccatatcctgtgcaagtttactgtaacggttagcaaaggtatgtacggcatcaataacgataagaaccgccttgtaaaatacattcttatcaatactttctggttttgtgaaatcaagagctgcttttaatttctttgtgcgttcttcgtaaccttttaaaccttcagctaagattcgttcgtaatttaccgccagatgagcatctccggcattgagcttaccttccattccaaagacaccagtttccatgaaaacacttacttcatcaggaagaagagcttctcctctggcacgaagattattgttttcccagaatggagcaatatcacgaagttgctgttttgtttcttctgtaatatagaaaacatcgccatctcttttttcaaaaaggtcaagctcattcataacaaattccatcgtatattctgggaagataggtgcatttttgttctttgttgcctgattgcctgcgattaaggatttatcttcaatataaatgctcatgttttctaaaatcttttgtaacataagcgcgcgaaccatcactcgtggctgattttgattctctttataggcctgtgtggcaagtacggcacgttctgcatcaatatatggcttttcttctaatacttcttcacgaaaagcagccattctatcggttaatcgtccaaaatgttcctgattctccatagtgaaacctcctaaaaattacgttcgtaaattgtaactactgtgtttataaaattaaattaacattaatcctattaaatgtcaatatatttctttaagaaactgaaaatatttatgttcgtaagtttttatgtggatttgtaggagaagttatgctataatgacaatatatttttacgaaacaaagtaaatgataaaaatactctttacttaactaacggaaatatgtcaagcagttaaacaaaataaatatgtactgaaaaccttaaaaatgattatgaaaaaatatccaatataaaatgaaaaccgaggaggaataaaaaaatgaaaaaagcagacagaacaaaaaaaggaatgatatttaacatccaaaaattcagtgtaaatgatggaccaggaattcgaacagttgtattttttaaaggatgtccacttcattgtgcctggtgtgccaatccagagagtcagtattcagaaatgcagatattatggaatatggaaaaatgtgtccgctgccatcattgtatggaaatctgtccgaaaaaggcgattactttcttttcaaatgaaataaaaataaatccatatatctgtaatggctgtcaaaaatgcattgaagaatgtcctgcaagagcgttgcaggcagaaggagaggagaagaccgtacagggagtactggacgttgttcttcaggataaagttttttatgaagaaagcggtggtggaattactctgtctggtggcgaaatgttatatcagccagactttgcattacagcttcttttagctgcaaaagaagaaggactgcatacctgctgcgaaacgacaggatttctgaaaacagagctgtttgctaaaataatagagcaggtagattatattctttttgatatgaagcattggaacagtaaaaaacataaagagggagcaggcatttataacgaattgatactatcgaatatgacttatgccgtcaaagttggaaaaaaagtacttccaagaatccctgttattccgggcttcaatgactctttagaagatgcaatacagtttgccgcaactttaaggaacataggaattaccacctgccagctcctgccatttcatcagttcggtgaaaataaatatgatttattaggaaaacattatgcctataaacaccagccatctcttcataaagaagatttagaagaatataaagatacctttataaaaaatggaattaaagcatttttctaaaaaacacctttgttttctttcgttcgtaaataaaatgcattgaaaatttacgaatttcttagtatactatatttaacggacgaaaatgtggaaatagattgtagagtatcaatgaattaaataacggaattaccaaaatgaaaggattcatttatgaaaaatagaggtaataaaatattagaattattgacaaaagataataaaatagaggtttcgcaccttgcagaagaactaggtgtttcccaggtgacaatgcgaaaggatttggatacactagaaagcaagggagtcatcaaaagagaacatggatttgcccttctttgtagtacggatgatattaacggaagaattgcctatcattatgaagaaaaaagaaaaatagcgcagaaagcggcaggattggtttctaatggagataccattatgatcgaaaatggaagctgttgtgccttgctggccgatacacttactacaacaaaaaaggatttaacgattattacaaacagcgcatttattgcagaatatattcgtggaaaatccaattttcagattaatcttttgggtggtatttatcagcaggattctcaggtaatggtcggcccgatgattttacagtgcgtggagaatttctttgtagaccgcttctttattggaacagatggctattctacgaagatgggatttaccaatcaagaccagatgcgtgcacaggcagtaagagatatggcaagacaggcagaagaagtgattgttttgaccgaaagtgagaaattctctaaacgaggaattgtacctttgaacttaaaagaccagataaaagccgttattacagatagtgagattgactctttttatgaagcagaattaataagtaaaaggattcaggtaattaaagcctaaaaaatgtttgaaatactcttatagtaatttatatattttagaaatcgagtagaacttttttgtaattcaattattgagtacttcattaaagagaattctggaaggagatttactatgggaatttatttaaatccggggaatgcatcttttcgtggaagtttacgttcaaaaatttatgtagataagagcggtttgatagctaaaacaaatgatgttatatgtacagaacaaaaatatgtttgtgtcagcgaaatggctataataatagtatgactgttttgtataaaattataagattatggagcgcttagacatgaagaataattcaagttcaaaaaagacatcatatattaccagaggagcgatgattcttctaacaacaattttaatcatattatttttctgtatcatgctattagtcagccagattcagggaacggctaggattgtcaattatgcaggattggtgcgtggtaagacgcagcgtattatcaagcttgaagatgcagggcagccacatgatgagatgattgacagtgtttcttcctatataaaaggacttcgttacggcagtgatgagttgaatcttgtccgtttggaagatagggcttttcagagtaaaatgcaggaactgaacagctattttaaagaattatgtgaagaaatccagcgcgtccgtgaagttgggtatgaaaatacagcaattatcgataagagcgagcatttttttcagatatgcgatgaagctacaggtttagcagaagcatattctcaaagaaaggcaaccgctctcagtcagttagagacaattgtttttgtggacataggtggacttgttattttaattgcccttgaattgataaaggcacttcgctatgcggcccagaatcgcattttgcagagtaaagtgtatttagatgaggcaacgggacttcctaataagaataaatgtgaagagattcttaatgcttcggacctactttcagcacaagatgcagtagccatctgtgtttttgacttaaataatcttcgaaatattaataataatttaggacatgataagggggatgaatatatccgttcctttgcagtacagttgcgtattgctgttgcagatgagtattttgttggacgtgatggtggtgatgaatttatcgctgtcttaaaaaatgtcactcgtatgcaggtggaagaatgtcttagagatattcgggaacaggcggcaaaatattcaaaggaatacccagaaatgccaatcagttatgcagttggttatgcaatgtcgcaggattttgaacaatctaccatgcgggaattattccgttatgcagataaaaatatgtacattgataagaatcgtgccaaaatggaagaggccgcagaagaaaagcggatgaatcagcgactactggcaaaagtaaaggagatgggatatcagttttctgactgtctttattgtgatgtatttatggatcagtatcgtgttctccgtgcaagtagtaaatttttccttgcagaagatggaagttattcaggtgcagtagaacagattgtacataaactggcaacagattccacgagaaaaaagatgtggtcacagcttcagattgactatttaaaagagcatatgacagaggaacagcccattcatgaaatctcatataagtatacagaagaagatgtcacgatacatggccggttaaccggtattttttgcgatactggaagagatggaactgtacatcactttattttgggttttgaagtatttcatgacagaaatgttgccgcttccgatgagaagttacagctcacacaatactatgaacagatgaagcaggcaattcttgaaaatggaaattatgtggaagcattattagatactgccgaggcagtatacacagttgattttacacatgatcgtttagaaaagattttttatcattcagagagtgcacgagaatttgatttaaagattgttctgccttgttcttatgatacctattgtttaaaacaacgagaatttattacgaaagataccatggagaactatcgtattgtagaagcttctgcaaagttgttaggacgtttttgtagtggagaaaaacaggtaactgtagaatatcgggaaagaggacaaaacggcaaattaatttggctgcaaaaaactgtgctaatgtctcaggatactgtctatgacagtgaacttcaggaagagacaaaggtagtccatggaattattctatttaaagatacatcggtattccatgaaaaggaacaacaggaaaaagagcgacttcaacttgcttttgaaaaggcagattctgcaagtaaagcaaaaacagaatttgtcaaccgtatgagtcacgatattcgtacaccaattaatggaattatgggaatgcttgatattattcgtaaaaataaagaaaatccagcgaaactcgaagagtgtcttggtaaaattcagctgtctgctggtcatcttatggcacttgcagatgacgttcttgatatgagtaaattagaatccggacgacttgtattagaagaagtttcttttgatttattacagcttatggcagatgtaacttctctggtaaatgcacagttacttgagatgaagctgtcccaccatacatatcgaaagaatttaaagcatacgattttacttggaagtccaacccgacttcgtcagattatgctgaacttattcagcaatgcaattaaatacaataaggtaggaggaaaaattgatacctacgccaaagaaatttcttttgacggaattacagtctggtatgaatttaaaataaaagacagtggtatcggcatgagtgaaaagtttgtaaaagaagaattgtttgacattttcacgcaggaacagacggatgctcggacacactataaaggaagcgggcttggtatgtccattgtaaaacaacttattaaagcaatgcatggaacaattgaagtaaaaagtacacttggagaaggtactacatttgtttttcagctgccatttaaaataagtgaacaatcaggaacgaaaatagaagaaaaatactcattcaatgcagaaaaagcagcaggtaaaatgtacacagatacacaggaaagggaatcttctgtttcttctaacggtgaagaatctgcacaaaataatctgaacggaatcaatattctcttagtagaagacaacgatttaaatatggaaattgcagaattctatttatctgatcgtggagcaatgattgaaaaagcatggaatggccaagaagctttagataaatttacatcctccgctccaaatacttacgatataatactcatggatattatgatgccggtaatggatggcttagaaacctgtcgaaagattcgtacttccaaccatccagaagggaaaaatattccgattattgcaatgacagctcaggtttcacaggaatgtatggacaaatgtcagcttgctggaatgaatggccatctgacaaaaccagtcacatcagagaaattgataaaaacaataatggagtttactatttaattcattagacaaactacagacgaagccattgcccccaataaggcatatttgtgattttagtcgcggcgcgttgaatgttcgctccacgcgctcgcattcaacacttgctccgagaccacaaatatgccttattgggggcaatggcttctgtgctgtggctggagaagatgaattaaacagggggaggagatttggggacagaagctgatgtcttctacttactcgagaatgactgggaatagaggggatgatttgacctgtctgtatgtaatagtaaaatgaagaaatcggcattttaaatttgattttataaatattgtggatgataacataataattacatcaatctgcttaaaatctagtatagtatccaatcagtaataataggttacgaataatcttttagcagcttacaataaaagataaacgaatcaaactgggataaaaaaatatttatctacaatattctgagagcaagcagaaaacttctagcctctccctcaaatccccacaactactatttaattcaaacaaaagacaaccaaagacagcccgagaagagaaccgataccctatatttgtggcctcggagcaaggtttagatgcgagcgtataaagcgagcatttaaaccgccgcgactaaagtcacaaatatagggtatcggttctctgggagtctgtctcttaatgaattaaatagtaatttgacaaattttattttcagggatattattggtagggaatttgtgaaaatagttagaggtatacaaatgatgcaaaagctaaaagaagagaattatccagtgcgtattctggtatatatttttggactttttattatgacactcgggatttcaatgtcagtaaagtctgatcttggagtatcaccagtaagttcaattccgtattctattcctttttaataaagtaaaaataggatttgatgtgagtatggtcacaatttcattaatttcctgtttacttacacttagacggcttggttcagttggtgttggtacaattattgcggctgttcttgtaggaaccgttcttggatttgtgacaagattatttggggtaaaaagagatgcaatcttatatccaaagggaagaatttctaaataatagtataaagggaaatatgttaatttatatacactctaattataagaattatacaggataagaaaggaatctacatagtatgcgaattttattaataagacacggtgaccctgattatgaaaatgatacattgactgaaaaaggatgcagagaagcagagctactggctaaacgggcattgtctcttcatatgggtaaatgttatgtttctccgcttggaagagcacaacgtacggcacttccgtctttagaagcggctggatgcaaagcagaaactgtggaatggctgcaggagtttccggctaagttagatgttaataaagctccggaacttgcggaagcttatccggatattgaaaaagagggagaaaagtatcgcccaagaattgtgtgggatatggcaccgggatatttgacagaacatgaagaatatatggacaaaataaattggagacattctttagtagcaaaatgttctgatatggaagacgtatatgataaagttacaaaagaatttgacacactcctcgcaaaacacggttatgtccgtgaaaatggttattatcgtgtagaaaaagaaagtacagaaacaataactttattctgtcattttggactgatctgtgtattgctttctcatttatggaatgtttctccatttactttatggaatagctttgcattagcaccgacttccgttaccgaagttgtcaccgaagaacgaaaacagggtattgcatatttccgtggtttaaaaataggagatatttcacatttatatgccggaaatgaagaaccatcgtttgcggcgcgcttttgcgaaacatatagtaataaagaacaaagacattaatcctgatttgtgaggctgcaaagcagacgaactcctgaagcgaaataaagcatatttgtggcctcggagcaaggtttggatacgagcgtgtgtaagcgagtattcaaaccgccgcgactaaagtcacaaatataggggataggctctctttgctggcgtctattcagctcgataaatcagaattcatctgtttcaattctgggagaactgtcaagagcattacgatgaagcacaaactgccgccaattacattggatactggttcggccataaacactccgttgcttcccatatggaatacgtaagggaacatgtatgtcattggtacaacaatgataactttacgcaggatagagaagaagattgcctgttttttcttatttaatgatttaaacatagtctgtccagtatactgaaagagcatgaaaataaatgcggaaaaatatagtttcattgcagggacagtatcaatcatcaagcttttatcagaactgaaaattccaattaaaaatttaggtgcaaataaaataacactccaggcgattaaactgtaaatcaaagcaaggacggacattgtaatccaggcttcaataactttctttggtctttttgcaccataattatagctgatcactggtgaagaaccctcggagatagaccagattggggtttctatcatctgacggacgctggaaataatcgtcataacggaaacataaacatctccgccagtagcggaaagtacattgttacaacaaatgcttacaaggctgttcgtaagctgcataacaaatccggctgttccgaggcttacgatattcttcgcatcttttccgcaggttcggatttcttccttatataataaacggactttatattctgccttttttgaaagaaaatataaaacaaatcctgcagataagcattgggacaaaactgttgcgattgctgctccccggataccaagatcaagcataaaaatgaaaagtggatcgaggacaatattagctatggcaccaataacaacagaaatcattcctgtcgttgcatatccctgtgcattaatgaatggattcattcctgttgcaatcatggaaggaaaagttccaatcagataaatcataatatatggataagcgtatacgagtgcattttcagaagcaccaaaaagaattagaatcgggcgggcaaatataaatccaatgcacattaacacgattgcacatacagagagcataaaaaatgaagtgttcataatcatgccagctctttttttatcgccgcgtcctcgttcaatagaaaaaagaggagcaccaccactgccaaataaattgctaaatgcagtaataattacaatgatcggaaaacataatccaaccgctcctaaagccgccgttccgatatttggtattcttgcaatatagattcgatctacaatattataaagaagacttaaaatctgggcgaccaacatcggcagtgctgcctgtaagatattagtcgtaatcttcccgttatcaaaatcaatacgtttcataaatacaatcacttcctgttattttttacattgtttttacttaaaagattataccatgaagtaaagcatatgaataatattctttttatatcaaaactaaataaattttagatggataagtcgtaataagtgatcgtttatggtatatttatggtaattctataaaatatcaccattttttatatcaggttgtatattttactatgatattcactaaaatatattcgaaaaatcatcttattaaaatatatgtcataatctaccaaaatcatttttcaaatatactcgataaccgttgatgtgacatcctcccccacctgtagaggtgggggcttcccaacctcggcaagtttggttctcgttcgataacacttctgtgctaagcataagcgagctatccccgtgtgtcccacggttgtgttatattgtgtcaaggtcatgcattcaccagccgcattccctcatttctgatatttaccgccgcatttacatctctgtcatgatgggttccacaccgcggacaatcccactctcttaacgcaagatttttcgtttttgcatttttgtaaccacaaacagaacaggtctggctgcttgcaaaaaatctactcaccttcacaagtttcttaccctgctcctctagtttgtatctcaaaaatgttgtgaacattccccagccgttatccgaaacagatttcccaaaattcagcgaccgcgacattgctttcatatccaaatcttctatacatacgcaatcataagcattggctatctgtcttgactgcttatgcagaaagtcttttcgttgattggaaaccttttcgtgaagttttgccaccttaagtctctgcttattacgattgtttgaacttttctgcattttggaaagcttacgttgttctctcgctaattttttctctgcgttcctgtaataccttggataggcaggttccttaccgttgctgtcacgatataattcatgcatggaaaaatccagacctaaaaacttttgcatctccttttcctgtacttgatcttcatactcaaaaagaatacttgcatagtattttccacttggtgtctgacttactgttacagatttcagtctgtattcctctggaataatcctgtgctgttttaaccgtatttgtccaatcttaggtaatctcaaatatccattagacagagttatgttcccattgatgcagaccgtggaatagctgtttttattccgcttttttgatttgaaccttgggaaacctgttttcggctgtttgaaaaagttctgaaatgccgtatcaagatgcctgagtgattgttgtaatgcgatactgtctatttcttttaaaaatctgtattcttccgttttcttcattgcagctatttcttttgcgcaaatggtatatgttacgtttgtcttgttctcctcgtactgcttgatctttctatcaagccaatgattgtataccattctaacacacccaaaagtcttagcaaacaaaatcttctgttcatcattgggatagattctgaatttatatgctctgtttgccaccatgccacttccttttcctcgaaaacccacctgcgatacttgaacacaagcgcaagatgatagtatagtaagaatactaaatgtgcgttattatctcaattttttgtatctcaattttttattatccgactaaagatactatactataatcaggatgcactatcaagtaggtagcagacgcaattcatctcccaccttagaggtcggagtcttcttgctgtaagaggataaaacaattagaatattttcgggcaatcgtagatgcaggaacaatcagtggagcagcacgaaatctccatatgacacagcctccgcttagttatcaaattaaaatgttagaagaagaacttggtgtaaagctttttgtacgaggtgcaaaaaatactactcttacagaagcgggaaaagcgttatacataagagctggaagtctgctcacaatggcagatattacaaaaagagaagtaatcaaggcaaatgaagtagcaacaattcatattggactggcaccatctactgtatctatgatggcaaagcaatttaaggcatccatgcgtcctttagcagataaatgttttgtttataaaattgatagtgatgagttgattacagaagttttacttgcatggaacaaagaaaaagtgacggatgagattaaagaatttttggagtttctatttaaccagtttgattagctgttattaggacaaaaaattttatcctcaaacttttaagataggccactgaaaaagtccttttggtgtgcaaatcaacacaaaataaaatatgactattagagcgtgttatatattgtacgcaaaatcagtttttcagtggacacctaaggtggaggtgaattgcgtctgttacccacttgacattatttttgtaacttagtcagctgaagccgtaagttatatttttcttcttttgcttcgtcaagtgcattcctaagttcttctatcttggagagcatttcccgttctttttcgatgacagctcgttctttaataagttcagattcttttgattgctcggcaagttgaatatgcaacacatttagttctttttcctgttcagagagaagtttagtcttttcggagagttgtgcctgtattgtttcatgctctttgtatttctctgtatttagcttttcgatagtgacagaatttttgtgtgcttctttctttaattgttcgatttctttgatatgtagaagttcatttttctcgtaatcttttattttgaattgtaaatcagagactttttgctttaaagaagcattttctttttctaaggtatcgtaatttccagctttttgttcagcatcacggagcttttccgtgagcataatatttgtcttctctttttcttttacaagatttacggcagaagcagcctgttcttctgctgcctttctcgcagtctctgcagtttcctgtaattcctttaaatcagtatactttcgcaaagcatcttccttttcggaagcgagtttaccaagctgtatcttatagtttttttctaattcttctttgctttcacgaagttctgccatacggcgttcatattcagctcggatttcttctttgccggagagggcagcagtaaacaaattgcggatatttgtgattgaagcatctaatgcctcggtatcaacgccgcttctttttaattggtcttcctgcagatgagtggacacaagatcaaaaagacggtttagtgtaacaccttttttttcacctggttcctgtaattcttctattagtttattgccgcgagcgatgacattttcgtcggctgcgattgcaaaattcgccataataagttcctccaatttcttaaagacacattatgataaaatttttagcatcaaaatgtatattataattcttataattgtatttgtgtaatttgacaacagtgttttctttctattttgcataaaaaatatctttaaatgcgtttcttcctattataatagtgcatggtataatggtacacggtaatatttttataatagaaagaaaaaagctttattgaaactaagaatcctcttccaaaagccgttctctttttcttctggcaagcgtagcagtactgattccagtcattcgctccacttgcttataactatatccctcgtctaaaagcgatagcgcatgatcaatctttattttgctgattcttggccttccttctttaaaatcgtctttttgctttgcgattgctttcccctcctgcgttctttcaacgatcatatcacgttcaaactcagcaaaggcaagcataatcgttcgaatcagcctgccggtaggtgtattatccataatacccatatttaaaatatgcaccgtaacgcccttatcaagcatcatatctataagggcgattccctgtgtcgcactccttgcaattcggtccagctttgttactacaactttgtcaccgttctgtatcacttttagcaacttgtctaactgtggtctgtgcttttttgtccctgtaaatgcatctgcgtatatttcttctgcacctgcttctcttactgccgcttcctgtgcctctatactgtttccatccttcgcctgtcccttcgttgatactcggcagtatccgtaaaccatttaaaatcctccacttttgataataagttttgataaggctcacagccccattttccgttgtttctgagactttatcaatactgttaagttttgataagggtatattgcccctaaaatactctaaaatgcctcaaaaaccttttttacagcatacaacatctaaaaagaaagtgcaagacgcatttttataattaatattaattaatatattgtaattaatcccagatatggggtgagtatttaaaaataaacatcaaaaagtaaaaatatggtagaaaaatccgctttttattcctaaaagcaacgttgaaatcaaaaaatatgtcagaaaacattccatatacctctttgctatacgaatagcctataagtagataaaaataagggattttatgcgaatatttacgcgcatctcgtagcaagaatgcaggggtattcttgaatacggtgttcacaatacatgcatcaaaagcttattttaaagcgataaatggcagataataacataaaagtactagagcgtgtttcaaacacgctctaacacaaaaaaataaaaagaaagccatataacaagatatgcattagagcaaactcttaatatgaccagacattaagagtacagggatactaagcatctgttatatagctttctttttattttcgtctgttaaggatgtttaaattattttttgttcgctattacattgattttgccatctttctcgcttcgcgtttcttctcaagatttgaaacaataacgcagcaagaagcatcgccagtgatatttaccgtagtacgtcccatatcaaagatacggtctacaccagctactaaagcaattccgtcaacaggaagtccaacggaagtaagtaccattgcaagcataaccattcccgctccaggaacgccggcagtaccgattgaagctaaagtagcagtaaagatgattgtaagcatctgcggcagtgtaaggtggattccgtagcaggaagcaataaaaatcgcacatacaccctgataaatggcagttccgtccatgttgattgttgcaccaagtggaaggataaaagaggcgatttctctggaagttccaagtttctctgtacattccatgttaataggaagtgttccgacggatgaagcactggaaaatgcaaacatgattgccggaagcatttctttaaagaaagtaagagggctgattccaccgattgtttttactgcgaaagaataaacgacaactgcatgaacgatataacatacataggctgctaaaagtaccatcgcaagggaaccaatgatggttgcaccgtttgctgcaacaactggacaaagcaggcagaacacaccaataggagataactttaagatcatttccatacatttcataaatacatcgtttaaatcgttacatgctgtaatgatacgggtatttttttcttctccaacaagaataatcgcaaaaccgattaataatgccataacgataacctgtagcatatttgcctcagccatcggggagatgaagttggatgggaaaatatttacgatagtatccatcaaagatgttttctcaccaacctggtaggataagtctgtggttgcaattacagggaacattttcttaaataaattaccaccgatcagtccgattgtaatggcaaaagcagtagtacacatatagtaaacaactgtttttaaaccaatggcgccaactttttttatatcacgcatggaaatgattccgcacatgatggaaaataatacgataggaacaacaatgaacttaagcaggttcaaaaaaattgttccaaacggtttgatatacgtttcggcaaactgggcatgcttttgcaggagtaatccggcagcgatagccagaacaagagcaataaatatctgcatcgccagcgacatttttttcttttctttcataaataccatactctctttctttttctttagacataaataatggcattgttttatacaatgccttaatctgcaagattcattttagcacacttcataattgaaatcaattaatattcgaaattcatgataaaataaagtcatacaaaatattccttttctactgctgttggtttccagtgctctgcatgataatcgcatttggaacagagatgttcagcacccaaaagtgcatagcctgcaaacgtgatagtattttttagggaatgagattcgagagtaaggcatttgaaaaataagaagaaaaatttttgtttgactttttaaaaaacaggaaatataattataacaaacgagtagcaagtaagcgtaaatccagtttaccagctgctcgtttttttgttaaaaactaatattgcataaaaaagtgtgtagcctgtcagcgtaagtccagcttatatgacaaggcacacactttttttgtgcaaaaagagaggagctaaaacaaaatggcagaaagtaacaagatgaaagatatgtcagtgaataagctgatgatccagatgggaattccaatgatcctatctatggcattgcaggcggtctataacattgtagacagtgcatttgtaggaaatatgagagtaggcagtgaagcggcattaaatgcactgacactcgtattcccggtgcagatgcttatggttgcggtgggaatcggaacaggtgtaggaaccaatgcacttcttgcaaggacacttggacagggaaacagcaaaaaagctgcaaaggtagcaggaaacagtttgtttcttggtgtgattatttatgtggtttgtttcttatttggtatctttggagtaaaagcatatatttcatcgcagacagtagatacagaagtgcttgagatgggagtcagctatttgaggatatgctgcgtgatttcttttggtattatcttcttttcactatttgaaaagttattacaggcaacaggccgttctctttattctacaatcggacaggtagttggtgcagttgtaaatattattcttgatcctattatgatctatggtataggaccttttcctgaaatgggtgtaaaaggtgcagcttatgcaacggtaattggtcaggtagcatccgcagtgttactgttaatttttcatatgaaattgaataaggaatttgaacatgatgcgaaatatatgaagccggatattggcattataaaagaaatttatgcaatcggacttccggcaattattgctcaggctctgatgtctattatggtttatgtaatgaatctgattttgaagttcaatccgtcagcgcagacagcctatgggttgttttataaagttcagcagtttgttctcttccttgcgtttggtctgcgagatgcgatcaccccgatcattgcatttgcttatggaatgagaagtaaaaaaagaattcaggatggaatcaaatatgggcttctctatacgattgtattaatgattttgggaattgcaattacagagattttccctggagcttttgcaacgctgtttaatgcaggacagtcaagagaatattttatcagtgcgatgagagtgatttctattagttttctgtttgcgggaattaatgttgcttatcagggaatttatcaggcgctggatggtggtatggaatcattggttatttcacttctaagacagcttattatcattctgccactggcaggagttttttctttatttgtcagaaatggtcagatgggagtctccctgatttggtgggcgtttccgattactgaagtcattgcatgtctggcaggatatgtatttttaaagaaaatcagaaaaaataaggtcgatgttttaaattaaggaggaactggaaatggcaaaaagaattattacaatcagcagagaatttggaagcggtggacgctttatcggggaggaagtcgcaaaaaaacttggaattacttactatgataaaaatatcattagtgagattgcagaaaagtctggtttatcaccagaatatattcaggaaagcgcagagctatctcccaaaaaaggattatttgcctatgcacttgccggacgtgatattacaggaaaatccgttgaggatatggtatatgaggcacagagaaaggttatattggaactggcagagaaagagtcctgtgtaattattggaagaaatgcagattttatcctaaaagaccggaacgatgtattgaatgtatttatttatggggatatgccggaaaaaatacagcgtatcatgggcttatataatgtagaagagaaggaagctgtcaaaatgatagcggatatagataaaagacgtatgacaaattataacttttatacggatcaaaaatggggaaaagccagcaattacacgttgtgcctgaacagttcacagcttggatatgacagatgtgaagcgataattatggagtgtgcgaagtaaagcactgtttttttcttatcattataatatagaacagagagaagatggttgtcgttagccatcttttttctttttacggaaaaattttacggacaaatttgcaatagacttatttcaagaaaaaatgtataataaaagaaaaagattcgtcagcaaatcagccgaaagtctgggacacaaagctataggatctgcaaaatagcagccagttacaacgtttaagatgcattgcctgaaaagacagtgctttttttattttgagaatattggttagggacaggcagctaataattataaaccggggaaaagttatatggaagaatacagagatgatataaaaagtaaattgcattacatggatgaaatccttcataagatttcttttatgagtcaggcagagaatgaaaagcagctggatgacatgacaccatctatactaaagagtgttggaaaatatacagcagcagacagagcgtatatttttgaatggaattcagaaaagaaggaagttttaaaaatacatttgaatggtgtgcatcaggaattgaaccacagatacagaatctgcaggaagttctgtgctggtaatcagatgtgtcagtaatcgggtaaagaataacagaggtatagcagaatgaaaaaggacagcggaccgtataaaaagataaaaatatattgttatattgttggattgactgcttttctgacagcattttttgttggtatttttctactccataatctggaaaagaatgaaaagacaactggaaaatatatggcgcaggttacggagaaaagagtcagggcaagactggatcagtatatcatgctctctaatcttctgggaaattatatcagtgccggagaaaatctggatgagaatacgttttctgaactggcagaaaagattccaaatgaagatggtgtgataaaggcatttgagctggcacctgagggtattgttacagacatttatccgaaacaggaaaatgagggagcctttggactggatatgctacaggagcatgagcgaaaaaaggatgcagttgtggcaagggatagcggaaaatatacgattgggggaccataccagttaaagcagggaggaacaggagcactgctttttaatccagtttatcaggatagtaattcagacaaaggggagttctggggatttgtgattctggtgattgactggaatcgtttcattgatgaaataaatcttgattatttaagtgatgcagatttctgctacagaatctggagctatgacagagacggcaacgataggattattctggcagaaagtcaggatgatatgccggacaacattctgacagtagaatgcacagttcccaataacacatggtattttgacattatcccttcagagggatggattccacgttcttactggattatgtgtattgtcgtttcttatgtatactcattattggttgctacagtattttatttgatattcagcaaaaaacacagggaaagacaatatgaagcggagctgaaaaaatctgctgaacaggcaaaaaacgccagcgaggcaaaaacaagatttttattcaatatgagccatgatatccgaactccgatgaatgcaattgtgggtttttccggtttgttagagaagaatctgcagaatgaaaaaaaggcaaaagaatatctgggaaagatacagtcttccagtaatcttctgctgatgattatcaatcagattttggaaatggcccggattgaaagcggtacagcggtattacaattaaaagctgaggatatggatgcattatttcacagggtaaatacagtgtttgaagaggatatcagaaagaagaatctgcagtattatgccgatttagatataagacatcattatgttgtctgtgatcagacaaagttacaggagattatgctgaatattatcagcaatgctataaagtataccccggagggacattcaatctatgtagaaatacatgaggccgcatcagagaatccttcaaagatacattatattttttcatgtgaagatacgggcattggtatgagtgaagaatatcttccgcatgtctatgaagaattttccagagaacataccactacagaaaataaggtgcagggaacagggctgggactttctattatcaaatccatgatagaactgatggatggaagtattcaggtagaaagcagacagggcattggaacaaaatttacggtagatctttcttttgacatagcatcgaaagaagaggtatatggaaatcagaatgccatgaagccacccgcaattcacacgataaaaggaacaagaattctccttgtagaggataatgagctgaatgcggaaatagcgaagacagttctcgaagatgtcggagcgttgattacccgagtggaagatggacagcaggcagtgaaattatttaaagagaaaccggcaggaacatttgatgcaattttaatggatctgatgatgcctgttatggatggatatacagctacgaagaaaatcaggtcgttagaacgttcagatgcaaaaacaataccgattatagctatgacagcgaatgcatttcaggaagatgctgaaaagtgcattgccgtagggatgaatgctcatctggcaaaacctttaaatatagaaaaaatgatgacaacaatctgtcatttagtaaaaaagaaaaatgaatgaaatatacatttttgcttattattttatgcttaatctggcagctatacatggcatcatccttggcgttggggttttaaatacgctctatttttgtagagagacaaattttttatattttttctgataaattatctattaaaaaaataaaggtggaaattaacaaatgttgatttccacctttcgcaacttacaataaaatcctttcacccgaagtttctttttggaactgtagtagagtagggaaatagaaatagaaacagaagtgaaagaaccttcgggagaaagaaattcaggataactcttcctgaaaatgttgaataatcaaatctgcacaggagatgccatgcaaaaatctgattaggaacatacaattataaatacatattcttatgtgaaaacataggaatcacataacatatgccggagtattaacatctttaaatacccacttgttgcagtataacaggattttaatattaagtcaataaaaaatgcaaatatttttatgtttatattttcacatatatttttttgcaaatattttcactttttattctgtacagattgacacagtgtcgttgatactttataataaattgataaatacggcatggctgtgggggaaaagtatgaaaaatgataaaataattaaaataattcgagtagctaaaaagtattatgaatcgcatatggatcagaaggttatcgcacaggaagagggaatgtctgtatcaactgtcagtagaatgttaaagaaagcagaagagatgggatatatcaaaattactgtggaatatcctgtgttatctaacgaggaactatctgcttctttaaagaaaaagtataatttagagaaagtatttctcgttccaaagctttcagatgcgcctgttgcagtacaggaagatgtctgtagagcagcagcaaaagatttatcttcctatttaaatgacggaagtattatcggaactgcctgggggcgtaccatgaaaagctttgcaaattatgtttctgatttgggcgtgcataacgtgaaagtggtgcagattaatggaaaaacgaatgagacatctgttcctgtcggtgcagatgatttgtcacaggcaattgccagagcaggacacggggaagcttatgtcattccagcaccagtcgcagtagattctgccgagattgcagagatgctaaaaaaagaaagaaatatctctgccgcactcacattagcacgagaatgccagattgctctctttggagtaggtaatctgagtcggaataccattctatatcgttccggttctttaaaagaagaagactttattgaactagaagaaaaaggagcggtaggagatgtctgcacctgcttctttgatgcacggggagaagcggtaagcagttcttttgcaaaaagacgtattagcattacattagaagaactgaaaaaaattccatgtaaaattggagttgcttctggacttgagaaaaaagaagcacttcatgctgcattactgggcgaatacataaatatactctatgccgatgaagaattaggaaaagagttaattgctatttaattcattagatacactacagacgaagccactgctcccaataaggcatatttgtggtctcggagcaaggtttagatgcgagcgcataaagcgagcatttaaaccgctgcgactaaagtcacaaatatagggtatcggttctcttcccgggcgtctgtctcttaatgaattaaatagtaaattactgatgatagtgatttaagaagtctgccatactatctgttgccttttttaatacctcaattcgcggtaaatataccacacggaagtggtcgggctgctgccagttaaatccaccaccgtgaatgagaaggactttcttttcacgaaggagatctaatacgaattgttcatcgttcacgatgttgaactttttcgtatcaattttggggaaaatgtaaaaggctgcctttggttttacggcactgattcctgggatgtctgtcagcgctttgtaaataaattcacgttgttcataaattcttccacctggcataatataatcttctacgctctggtgaccgccaagtgccgtctgtacgatggactggcctggaacattggagcagagacgcatattagagagcatgtttaatccctcaatatagtcttttgccatagccttatttccacttaaaatcatccagccgacacggaaaccggcaatcatatgtgatttggataatccgctgaatgttacacagaataaatccggtgcgagagaagcgatggaaatatgtttttcaccatccataacaagacggtcatagatttcatcagaaaaaatgattaactgatgttctcttgctacctgtacaatctgctctaatacctcctttgggtatagcgcacctgttgggttgtttggattgatgataacaatggcctttgtgcggtcattgatttttttgcggatatcatcaatgtctggataccattcggattcttcatcacaaatatagtgaacaggttttccgccagctaatgtagcacaagcagtccataatgggtaatctggagaaggaatcaggatttcgtctccattatcaagaagtgcggacatacaaagattaatcagttcactaactccatttccggtgtagatatcgttaatatttacatttgggatatgttttagctgtgcgtactgcatgattgcttttctggctgaaaagagtcccattgcattggaatatccttcacaatctgttaactgttgacgcatatcatagatgacttcatctggtgtacggaaaccaaatggagcaggattaccaatatttaattttaaaacatgagttccggcttcttccatacgggtggcttcatcaacaaccggtcctctcacatcatataaaacattgtctaatttggatgatttcttaaattcacgcatttttttcccctctttattgctaatattcctgctaatagttgctgcagaagttgtttgtatattcttattgatatcacttataatttctgcttcgaaaattgaacttttctgtcttttagcagacattgtaagtgcttctgaattttctttgttactatttcctaatatggttttgtttgtatctaatatatttctattagtggcagagatttctgtatcagattccacattagatactccaattaaccattcttcctctacctgtaatgttttcgccagaaacagtaaaatatccgttcgtggaactgttttaccgcttacatactggcttacatgactttttccaagtttaattccctgtacttgtgccgctcgtacaaggtcaatctgctttaggttctgcttcttcatggcagcttttaatcgttctgagaagacttctttttgaatcatgtagctgctcctttctattttttgtaattgaatcacaagttcaatttactttatttttttcgtaaaagttaggtagagtatagcataaagaaaaataaagttcaatacaaaataaatattcttgaacttttttgtattgaacttttatacaactacacataaatattttgatatgatgagacctgtttgtaggcagccagaaattattcatttaacaattaaaagggaacgaaagtatagttcttttatcgtgtaaaataaaagggggaaaaagaagagaatcgtaaaatatggctaggaaaagcttgatatgatatacttttaaagtattagaataaattcaattacgaatacgcaattgaaaatttacaaaataagaaaggcaggtcttagaaattgaaaatgatacatagtttaataattctagcaggtacagtttttttcatatggttcagcattccattattcactcaccgaattttaaatattgggaatcttacagggttagtggtcagtggtattttactgatagggggcattttttataagaattttcagcaaggaatattttatttgcaaaaatattttttgggaaaatgtgtgattggtattatggcaattgctattggcattgtagttataactgctgttatcgaaaccgttcttatcgtaaaggcatcagcaaaaaagccgcaggagaatgcaacacttattgtacttggatgtaaagtatacggcgaacatgccagccgctctttgcgtgaaaggttagatgccgccctcatttatttagaggaaaatcccaattcacaatgtattgtatctggtggaatgggcgagggagaaaaaatcagtgaagcggagtgtatgtaccgatacctaacaaagaagggaattaattcttcaagaatcataaaagaagataaatcaacttctacgagggaaaatctgcgattttctaaaaaaataatggaagaaaaaggattggggaacaatatagcgattgcaacgagtgaatatcatcagtatcgtgcttcacagatagcaaaatcacttggtttttctgttggagcagtatcaggacatactgcctggtggttatttccaacattttatatgagggagttatatgggattttatatcaggcattgtaggtaaaaagagattgttatttgtataataaaaaaatagtcgaaaatattaaagaagttgtttatttatcgtaaggaatgatttttcaaacacgctctaaaaagggggaaaacatgtatgaaggttcttataataccagatgttcatttgaaaccatttatgtttaaacaggcagcagaattaatggagaggggaattgcgaaaagagctgtttgtctgatggatattcctgatgactggaacaagcagtttgacatctcactttatgagcaaacttatgatgcagctatcagttttgcaaaaaaatatcccgataccgcctggtgctacggaaatcatgatttaagttatgtctggcataagttggaaacgggatatagccctatggccgcttatactgtacaaaagaaattgattgatttaaaggaagtattgccagagggtaatctaataaagtatgtgcatcgaattgataatgttttgttttctcatgcagggatgtcgaaagactttgttaatctgcatgttcctaaatcaaaatatgatgatgtagatgatgttttagattatgttaatcatcttggagaaatgaagatgtggtatgatggatccccaatctggctcagaccacagtatacagatgtgaagatgtataaatcacaacaattcctgcaggtagtcgggcatactccgatggaaactattacaaaaaagaaaaatgtgatatcatgcgatgtattttccacatatcgggatggcaaaccaataggaacagaagaattccttttattagatactattacatgggattatagtatggttaattatggaaattattaaatcattttatcaagagaatactacgtgtatttataaatatatgaaaccaatacaatcagctttgaacaagaaccagcaaatattgatgatataatggaaactattaatcattttcaatgttttgattatatgattgattctgcaaatgatatattagacgaggattttattaaaaatactcataaaatattaaagacaaatacatctgatagtagaatttcatggtttaacgtgggcgaatataaatcaaggaaaaatatggtgggagatttgattaccacaccacctgaaaaagtaaaaagtacaatagaaaaattgcttaacgaatacaataaaaaacagacggtatcatttgacgatattttagattttcatgtaaagttcgaaagaatacatccgtttcaagatggaaacggtcgcgttggaagaattattatgttcaaagaatgtctgaaatataacattgttcctttcattattgaggataatttaaaaatgtattattaccgtggtttaaaagaatgggataatgaaaaggggtatctgagagatacttgcctgacagcacaggatagatataaacagtatctggattattttgaaataaaatattgaaaatttttgaatttaaaggatttatcactacaaaggataggtccttttttattctaacttgtaataataattttttttaaataacacttgcaaaataccctcacagggtatataatcccatttatctgataaagaataaaatttacagaagggagaatgctatgggagagtgttgtaataataaagaagatatttctttatcttgtcattgtggagcgaatgatagttttaaaagcaattcttctcaaccgaagtgtcaaaattgcagtgtaaagaagaaagttcgttcagaaaaagaatttaaggccttgctcaatcgtttaagccgtatcgaaggacaggttcgtggtgttcggtcgatgttggagaatgatgcgtactgtattgatattcttacacaggtatctgcaattaatgcagcattgaatagctttaataaagtattgattgcaaatcatatccgtacctgtgtaaaagaaaatattcaggcgggaaatgatgaggttgtggaagaattagtatccacattgcagaagcttatgaagtaacaattttcagtaatttaatcattcagaagaaagtatcgtttttaggtatatcggatgtgagatgattcccacctcgcatgacgcgcatctcgcagcaagaataccggggcattcttgaattcatgatataaagatacattttaaaaacataataataaatttgacaggaggataaaaacagatggagcagtataacgtaaccggaatgacttgtgccgcatgtcaggcgcgtgtagagaaagtggtctctaaagttcctggtgttacaagtgtttcggtgaatcttttaacgaattctatgggagtagagggaacagctctttcaacagatattgttgctgcagtagaaaaggccggttaccatgcttctgtaaaaggagccgagaaagagagtagtcagggagcggaagctctggcagatacagaaacaccaaagctattaaagagattaattatttctcttatctttttaatgccacttatgtacctttccatgggacatatgatgtggaactggccattgccgggatttttaaataataatcatgtaggcatggggcttgcacagcttttatttaccgtaattattatggtaatcaatcagcgtttctttatcagtggatttacaagccttattcacagggcaccaaatatggataccctggttgcgatgggggcaacggcagcatttagctatagtacgtatgccttgttcgcaatgacggcagcacagactgcaggtaataataagcttgttatgagctatatgcatgaattctattttgaatctgctgccatgattcttacactgattactcttggtaaaacattagaggcatattcaaaaggaaagacaacagatgcattaaaaagtcttatgaatcttgctccgaagatggctaccgttgttcgtaatggtcaggaacagatcatttccgcagaacaagtgaaaaagggcgatatttttcttgtaaaaccgggcgagagtataccggtagatggtattgttcttgaaggaaacagtgcaattgatgaggcagctcttactggagagagtattccagtagataaggcagaaggagacaatgtttctgcagcaacaattaaccaatctggatttttaaaatgtgaggctacaagagtaggagaggatacaaccctttcccagattattaagatggtaagtgatgcagcagcaacaaaagcgcctatcgccaagattgctgataaagtgtctggtatttttgtaccggcagttattacgattgcggttatcacgattattggctggcttcttgccggacagacagttggatttgcccttgcaagaggtatttctgttcttgtgatcagttgtccctgtgcgttaggtcttgcgacaccagtagcgattatggttggtaatggcgttggtgcaaagaatggtattttatttaagacggcggtatctttagaagaagcaggcaaagtcgatattgttgccttagataagaccggaacgattacaactggccaaccgaaagtaacggatattctttcggttgacggaatcagtgaacaggagcttttagaaacagcattttcactggaaaagaagagtgagcatccgttagcaaaggcaattgtagaatatggcgatgagaaaaaattcaccgttcctgttgtagaagattttcaggctgttcctggtaatggacttactggaacattaaataataaaacacttataggtggtaacttactttttatagaaaagagtttatctatctctgaaaaaataaaacatagtgcagagcaattagcgtctgccggaaaaacaccacttttctttgcaaaagataatcatctgcttggaattatcgccgtagctgacgtaattaaggaagatagcccacaggcaattaaagagttaaaggcgatggggattcatgttgtaatgctcaccggagataatgagcgtaccgcaagggcaatcggagaacaggcaggtgtagataatgtaatcgcaggcgttcttccagatggaaaggaaagcgttattcgtgcattaggcgaaaaaggaaaagttgctatggttggtgatggaattaatgatgctcccgctttaactcgcgctgatgtaggaatcgcaatcggagcaggtaccgatgtagcgatggatgccgccgatgttgtattgatgaagagtaaactcgcggatgttccggctgcaatccgcttaagccgaggcgtattacgaaatatccacgaaaacttattctgggcatttttctataacacaattggaattcctctggcagctggtctgttaatcccagtattaggatggaaattaaatccaatgtttggagcggcagcaatgagtttatccagtttctgtgttgttacaaacgcattacgtttaaacctgttaaatattcgaagtacaaaaaaagataaaaagaagaaaaaagcgatagatgttagtttaattaacataaataataatgaaaagaaagaggtaaatgaaatgacaaagacaatgaatatcaaaggaatgatgtgcggacactgtgaagcagcagtaaagaaagcattagaagcacttccagaggtagcttcagcagaagtaagccatgagaaggggacggctgtagttactttagaaaaagagattgcagatgatgtcttaaagaaaacagttgaagataaagattacgaagttgttgagattaagtaataatttgtcaggctaagcagctataaaaaagcattcttaaattccttagagaaataggatgcttttttattttcaagaatagattggaaaagtattgaataaaataaaaatatttctattagaaaattagaaaacaatttaaatataggattatttttgcgtaatataacgtaaagtgacgttatattattttacaaggatatatagctggaagagaaaaagatattatgtccctgaattcgatggttttataaggagattgagtgagtataaacatctgtggcctcggagcaagtgctggatgcgagcataagggcgaacatccaacacgtagcgactaaagtcacagatataaagaggtttatttcttatggcgtcagttttgccatagctgaatcaaatcagaagagttctctaactattcgcgaaatccaactttaacgaatagttgtaaaaaaagagtatctgtaaccgctttatatatctactatttacgttctaggttttcaactttataatttaggaggctcgacttaaattcaatgaaaaaaggccagcattttctgaccttttttcattggtaatcttcttactattttactttcagccctttaaaaatcttcttataaatcttttttaccttcttaggcacccgaataacaagctttttgtgagcatttttaaaagcttttttatttgcagctttttttgttaagcgcacagattttatggtgacagtttttagattcttacaattaaagaatgcattgctattgatttttataatatttgttcctatcgttacttttgtaagatttttattattgttaaaggccttcgctccaatggaagttactttgtaggttattccctgtacataaatttgggctggaacggttacatttttggtagttttacttgttttaacaagaattacctctgctcctggctttgatattttatactcgtttccagaaatagtatatgatgtacctgcctttggataagctaatttttctatggaaattatcctttttgctgtacacttcctacagcggtatgtaagttctcctgctgcctgataagtagctctttttgttactgtgccatcattccactgatgttctaactttggaagaatctttccttcttctaaaagggtcttacaaatacggcaataggtatctcccgtatatccttccgctttgcaggttgcagtttttttatttctaattcctttggaatgaccctttgcaacaatttcttcttttttcttatcattacaggtctgacaagcagaaatcgaatatccattttctgtgcatgtagcatccttctgttccattattttgtaattatgtgcagtctttttaatgctaactgtttctgtctcatcacagttttcgcatctgtaggttacgcttccttcttccttacaggtagcttcttttgtaactgtacctctatcccagtcatggtcatatttcttagttacttttccagaagaaatcagtattccgcaatctttacaatagatatctccggtataaccttctttttgacaggttgttttttctccatttctagtttctttgttcttatgattggttgcttttaaggtttccgtttttttataaggacagtttatataagtgcaacaatattctttttctccagtggctgtacaagttggttctactgttgttgttcctgaatctaaatcatgagtatgattctttccacaaccttctcggctacatgttgcggttccatccccattgtctttccaatcatgtcctaatgctggatttttggtatcttgctgagtgatcgtttttgaacagcggctacatttaccgtaaagaatgccatcactttcacaagttggtttatctctttttgttaggatatacctatgcccaagtttttttacagcttctgtttttgtagctgtacaaattccattttcttcataggtacaatgatatgttctttctccttgcgctgtacaggttggctctgtagttattgttccagaatcccatgcatgagtatgtgttgccttacatccgttacgagtacatatagcagtttcgtctccattatctttccagttatgacctaaagcagcaatacttctttgctctgttgttgctgtacagttttcattttgacaatggcggctttctgtacctgttttttcacaggttgcagctatatctgtagtccaggctgacgcataattatgtccagttgcaggaacgctttctttttttgtagtttgcctacagatgctacaggtaaaagttttttctccaggttctgtacatgttgactttttagtaacttttccagtgtcccaatgattcttacaatcatggacagatactgtcgaacctgatgcagtcataccataaagggttgcactcagatttgttgtaccctcctttaaaccagaaagctgattattgttataggatgctactgaggaatcgtctattgagacaacaggggtatccagaacaggtgctaagcctcttccctgtgacgagaaattaacaacatctattctggtctctgtaattattggtgttatgttctctcctattcgtaaggaataggcatcctggtcaaatgttacatcgaccgttttgattttctttttatctacagaaactgaaaccgtttctgtactgtcgtttgccggaatttccgttgtatttatctccggtctatttgcaaatacttctacccagtaatgtactccattataataaacgtggccaattccgacacaattataatcggaagaaagcatgtttctacgatgtccctgtccagcataaggctcatcatcttctctccaacccaaatttgcttcggcagccgttgtatgaccgacagagatattttcaccggctgcaagccatttaatgttttcttcattataaatgtcccaaactttaccccccattggacgttcatgctcataagataatgcgatttccgcagcacgtttcatagctactcgttcaagatcgtagtcatacttaagttcttctaagttcggacaagggattttttcattgtcatatgcatcccaacaccacgtatcgtaagggtttgttcgcatctcattaatcatatcaaaaatggttcgagcttctgtttgtccgtattttacggaaatatttaccggaataatatcagcagctttttcagcagctttggttttttgtggaaggataataagtcctccaataaaaagtaagagtaacaacagtcgtaattttgttttcttcatgttttcccctccaaatgtaatttttcaagaatattttctctttttcaatatatcatagatataccaatagtggaatgaaatttgttgaaggatgtcgttttttgtttttcaaacagatcctatgaattgtttttaaaggattttacaatctgatttaaaagtttttttctttttgtggaaaattgctctgcatcaaaatgatattttttattttggcaatcaagatactgatagctaaacaggcagtatccttctatttttttctgcttttttagataggaaagttcttttttcagcagggaggttttttgaagttctttttcatccgattgtcctggttcagtactacccatccgataaagctggagtccaatataaagttttactggtgagttctccataagaatgcaccacgcatcagtcactttatcaaatggagccacttcgtttgtaaatccccagtatatctgtggcattaaataatcgacatatccattttgggacacccatgtatcaatatctacataatattctaaatcactccgtagattatctaaatttccggcagggctgattccaaaagtaacatctgagttgatttcttttacagctttataaattccggatacaagtcgatttacgttatcacgtctccaatctgctaaagagatttcatttgaggatttatctgcagaagtgagcgatgttgaatccgtggatgacaaatttgttttcagctgttgtttatactctggagcatcaaatgctgttgttacatttttctcagtaaaggaaggataaaaataatcatccatatgaatgccatctacattataattttgtacgatttcttttacgccctgtataataagatttcttacactctctgaagaaggattataataaagactgccttcataagataaaatatttctttttgtgttttgaacggagaaccattttctggcgggatttgttttagaaagactgcgaatagaattaccggaggagatacgatacgggttaatccaggcttcaatagaaatgccctctttatgactcatttctgtcatgattttcagaggatcatatccaggatttttcccttgtgttccggaaatgcaggctgcccacggaaaataatctgatgcataaagagcatctccaaaagggcggacctgtacgataatcctgttacagccaatagtctttatctgttgtaaaatatgtttataaaactttcggaagctgctttcattattattttttacagacttccgatagctgttaaattctaaataactgagccagacagcacgataattcatagtatctgccgactgcgtggatgaattatttccttttttgctgtttcctttattagaagtaacagaagatttattactggaagccttttcctgcgtactgaaaaggaaatttataaattccgaactgctgcgtccacttatttttttctctattaaagcatatgagaataatatggcaatagtaagtaccataatgatgataaaattttcaatgagctttttcataaataaaatcctttcgtttgccataggcggaaacccactacctttaggtggtgggaggaaccttgttaactgttacccaatatgctacaatagccgtagcagttctgaaagagaaaaccgttagatgtgctgctcattaaagacactcttttgtacattgacaagatatgaggttgcaatacgaaattcgtgtattgcgtaaaatcttaaccgtaaaagatttttttactgtatagcatgggaagtttagtacctgatacagttacagatgagcatgtcttgtctgtaaagggtgctgtcagccaccctatgatgtaacgccactttagatagcaatatctatcggggattaaaggtcggaggtgtaagccgttagtacgactgggcagttacaaacccatgacctttaggtcgtgggtagttgacgtgccctccctcctgtttgacaaagttctatattatataatgtacgataaatttatttgaaacttctatgtaaaatttctctgccttataccagaaaaatattataacaaaatcatttttaaacgtctagtatgccgttttattggatttacgtcaaatacggaagaatgatttctagcttgtctgattctgtatgtttacatttatatatcttatgttttggcaggctggtgcatgcgtgaattatatgccaaactaatattttttctaaagcgtgtaaaaaatgccctaaaaaacagagttgaatgtatagaacatttgtgctaaattcaagtcaaacgtccgtgagactgggcgcgtgattctggtcagcgaagctgacatgttcctatcagaatcactgcgcatcctcgcggagcgtttatcccagtcggagattggactcccactgagacaaatttgctattactcaccacctgaagaggtgggagtcttctcgactgagataaataaaaaattagaaggaattattttatgaaattacagaaattattaagcttaacaagacaggcaatcgatgcctatggaatgattaaggaaaatgataaaattgcagtaggaatctctggcggaaaggacagtcttacacttctttatgcactgtcctatttgcgaaacttctatccacataaatttgatattgtagcggttacagtagatttaggatttgataatcttaatttagaagaaatcagggaattttgcaaaaaactaggtgtagaatatcagattataaaaacacagattgctgaagtagtttttcaagtccgcaaggaaagcaatccctgttctctttgcgcaaaaatgcgaaaaggtgcattgaacgatgccatgaaagaattaggctgtaataaagtagcctacgcacatcataaagatgatttattagaatctatgatgatgtcctttttatttgaagggcgaattcacacatttgctccagttacctatcttgaccgttcgggacttactgtaatccgccctcttctctttttatatgaaggagatgtgaaaggatttgtaaaagaatacaatcttccagtagtaaaaagtccctgcccggtcgatggttcgacaaagcgggaaaatgtaaagaatcttattggagaaatcaatcatcaatatcctggagcaaaggctcgtatgattcgtgcagtaattgatgatattgtaaatccagattgtcctccccaaaattaaagggatattttaatacaaaatttgtatatcaggaaatatttgaaaaatgctctggaaattatttagagcgtgtttaaaaagaaaggagtgatttttatgcagcagccaacctatgatgagcagattacaatgaaaaatgaaatgaagcttagagaactttgtgccggacttccagctttttgtaaagaattttttcgtggaattgaaccaacgacttcttctcggacacgaattgcttatgcttatgatttgaaaatattttttcattttcttcaggaaaaatatcctgatatcgaagaaagtgatttaaaaaactggcctgtaaccgttcttgacaaggtaacgctgacacagcttgaagaatatttagattatctacgcctctatgaggatgcagaaaacaaagttcatactaatgaagaacgaggacgtatgcgaaaaacagccagtatacggacattttataaatttttctaccgaaaacaagttattaaaaataatacagcaagcttgttaaatcttccgaagaaacatgaacacaccattgtccgattagaaattgacgaaattgcgaagctattagatgcagtagaagaaggagataatctaacaaaatcccagaaaaaatatcataataaaacaaaaatcagagatttagcaatcctcactctcctgctcgggacaggaatccgtgtctcagaatgtgttggaattgatatatctaacttagactttgaaacaaatggaatgaaaatccaccgaaaaggaggggcggatgttattctatactttggagaagaagtcagagaggcacttcttgactatcttgaagaacgagaaaaaataatcccaaaagaaggctccgaaaacgcactcttcctctctatgcaaaagcgtcgcatcagtgtacgtgcagtagagaacctcgtaaaaaaatatgcccgtccagtaacccctctaaaaacaattacacctcataaactgcgaagcacttatggtacacaactatatcaggaaacgggagatatttacttagttgccgatgttctcggtcataaagatgtcaatacgacacggaaacattatgcggcgatggaggaccagagaagacgaatggcagcggggaaaatacaattaagggaaaaataattctggtttacgtcaagtcaaacgcccctttgaagcacaataagccatatctgtgactttagtcgcggcgtgttgaatgtgagcgttaagagaacaacacttgctccgaggccacagatatggcttattgtgcttcaaaggggctgtctttggctactgggataaaaattagaattttatttttcgaataactgtaattaaatcgaaagtttgtctgtctgttcgttctactataaatcttaattataatatggaaccattaaataacaacctgcatttatctgatttgacttcatattattacatctcttaatttcatgaatatattgataaatatttataaatccagaatcattcgtattatccatgttctctttagcgatagaccacaggctgtctccattcttaatttcaactactttatattgtatatcattagctgattcttgtgcttttactaccctatctccaaaatataaaaagaaacacacgctgagtagacttattattaaaactgctcctgtaataaaaaatggtcgtttctcacgcaattctcgttggcgttttttcttttgtaattccgaaaaatcgtaaatctgtgcagttgttttcatacttatctcttgcatataatccctccatacataatgataactggttataaattattcatgtaataagatatatgtctcgaactaatattccgaacatatattccgtatgtatgtttgcattataccgaacattttttcggttgtcaatagaaaaaatgatttttcgaaaacattttcgaaaacacttgttttatgttttatcccatgatacaattatgataaaaatatacgtttataaaggagggtattttttgatgagctatggaaagataagtgcaaagcagaaagagatactagaatacataaagcagtctatattaagccacggttatcccccggctgttcgcgaaatctgtgaagcagttcatttaaaatctacttcttctgtacattctcatttagagacattagagaagaatggatatatcagacgtgacccatcgaaaccacgagcaattgagattatagatgacaactttaatcttacaagaagggaactagtaaatgtaccgattgtcggaactgtgacagctggagaaccaatccttgctatcgagaatattcagggttacttcccaattatgcctgagtttgtgaataataagcagacatttatgcttaaagtaaagggagaaagtatgattaatgctggtattttcgatggcgatttcattttggtagaagagacaccaacagcttctgataatgatattatcgtagcgttattagaagattctgttactgtaaagagatttttcaaagaagaagatcacatacgccttcagccagaaaatgatacaatggaaccaatcatcgtcccacaagattctccattttctattgttggtagagtcattggactgtatcgtgcatttaagtaatacattaaataggaatttgccggggtgagtaaacagccagaactcccagagaaaatataccctatatctgtgtcctcggagcaaggtttagatacgagcgcataagcgagcattcaaaccgccgcgactaaagtcacagatatagggtatattttctctgggagttctggctgttccaatccgataaatttggagtattcaacatgtcgcgactaaagtcacaaatatgccttatattggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaaggtcatacctaccgaactcctgctcaaaaagaagccgctgttttcgattacctttctggaaaaggttctctccgggatatctgtgcccggcacaaaatttcagatgcacagatactcagaagatggattatgaagtataatagtcatgataaggaaacaggaggaagaccgatcatgactaaaggaagaaaaactacatttgaagaacgtgttgagatcgttcaatattgcataaaacattctcataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaagacttctgcgggcggaaaaaagacgggcagaaatagagatatctttcttaaaaaaattagaagagatagagaggaggggaggctgagcctgatacgccaggaacatatctatcgggtaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccggatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagggaagaattagagaaggcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccatatatcattttgtgggcgtctgttttgcctgtggcaaattattattgtaaatcctctttagtaatctgttttccatctctccagattctctctaaatcataaaaagcacggtcttccttactaaatacatgaacaataatatctttatagtccataagaatccagtttgcactctggtatccctcaatctgttttgcatcgtaaccagctttgccgagagcttcttctgcgctgtcagccatagcctgtacctgattgcggttagaaccatctgcaatgataaagtaatctgcaagaacggatacttcactaatatcaataattgtaatgtcttctgcttttttatcttctaatgcctctacagcaagaagtgccattttctttgattcgttcataaataaatcctttcatgtactataatccgtttattataatctattataattgtcttatcaaacgggaatattgattctttaaacactgtctaaagtaagaaatttttatctcagtcgagaagactcccacctcttcaggtggtgagtaatagcaaatttgtctcagtgagagtccaatctccgactgagataaacgctccgcgaggatgcgcagtgattctgataggaacatgtcagcttcgctaaccagaatcacgcgccaagtctcacggacgttcgacttgaaattattgtgtctgatagttgacaattacttgttttctttataataatcaaatgttttctgtgtcatagggtctgtcacacttttcttttttgcgagataggcaatcgtatcctccaaaataagacgcagacaggcatctaagtctttaaaggcaagtgctcttacttctggaagatcttctgcctgattacgattggcttccatgtagtctgcaataaatacgattttatcaagtaaggacatctccgggcagcctgttgtgtgccagataatagcagaaagaatttccgggtcagttacgccgtataattcattcgcaaaacaggcgccaagtttggcatgaagaagttcaggattctttctttcataagcagaaacaggaattccatatcgctcacattcagaaagtttttcttcagaagaaagatatttagcacagtcatggagcagccctgctaagcgggctttttcgatatctgcaccatatcgcatggcaaggcaggtgctcgtatattctactcccattgtatgttcatatcttttagaagatagtttcttctttaaatcttcttttattttctgtattgacatcatatctactcattctccttttgtacttcttctggtggatcaggctgataaagattatgtccataaatataatcaactacttttgaaggaagaagataacgaatactttctccatctctgacacggcggcggatatcattagatgaaatctcgagtaccggtgaatttaaacgatatatcgttgcatcgtatttattttcaatatattcaatctggctgcttaaagaagttcccgtaccagctcttccggcaacgacgatggttgccatttctaaaatcttttctggatctttccaggattcgatatgatacagagaatctgcacccataataaaataatattcataaccgggatgttttactgtcagatgagaaagggtttctacagtatatgttgttccctctctgttaagttcttctttagaaagctgaaaatgcacattatcttctatcgcaagttctaccattgccaccctgtcttcttctgtgacagaattagaaatcttcttataataaggattctttgttggcatgatcagaatctcatcaaggttaaactgatgaaaagctgtctctgccaacaataaatgtccaaaatgaatgggattaaaagttcctcccataatacctatttttttatgctctgccatgacttttacctattatattatttatggtaatacgattttgctgttttcctttgctggtttatataaaacgattttctttccgataacctgaacgacctgagaacgagttctttctgcaagaacttctgcaatttctcttgggtcatcaaaacagttttttaatacggatactttgattaattctcttttatcaatcgcctcacggattccctcgattacttctggagtaagagatgcctttccaatctggaaaatagggtccattgtcattgcaagactttttaaataagctctctgtttgcttgtcataataattcctttctgaatagcttttatctatctataataatcaaatgcgaggttatataactttacagtatctccctcttcgattccaagttcctctaaacgttttaaaacaccattctctttcatgaatttctggaagaattcaaatcctttttcagattctaagtttgtgtatccaagcatacgctctactttaggtccttctacgctatatacacctggctcttccatcttgacaacgatagattcttcctcatcctcttcctgaagttcaaagaagaattcctgatcaaactcaattggttcttctggtaattcttttaacaggtcgttgacataccataaaagttctttaacaccctgtccgcttactgcggaaatagggaaaatctttatgtctttatcagcaaatgcctcttctaacatttcgataatcacttctctgtcctcttctggcatggcatccatcttattagctgcgattacctgtggacgctttgccagttctggattatatgcttccaattctttattgatagctttaatgtcctcaattggatctctgccttcaacagaagctgcatccacaagatgaatcattacctttgtacgctcaatgtgacgtaaaaactggtaaccaagtccaacaccctcagaagctccttcaataataccaggaatatctgcgataacgaaaccgttgccttctgctaagtcaacaacaccgagatttggattgagtgtggtgaagtgataattcgcaatctttggtcttgcgtttgttacacgggaaagcagtgtagactttccgacattagggaatccaatcaatccaacatcagcaattactttaagctctaaatccacccagagttccctggctctctgacctggctgtgcgtactttggagcctgcatggtagctgtagcatagtgctgattaccctttccgccacgacctccttttaagaggacaacaggttctgtacggtttgccatatcaaggatgacctttccagtctctgcatcttttacaactgttcctgcaggtacttttaaaatcatatcttctccgcttgctccggtacatctcttcttagagccttcttttccgtcaccagcgcaatattttcttttatgtcggtagtcaactaatgtatttaatccggggtcaactacaaatattaagtctccgccttttccaccgtctccgccatctggacctccgtccggtacataaagttctcttcggaaactgacgtgtccatctccgcccttaccagaacggataaagatgcgtgcgcgatctgcaaacattacatacacatcctttctataaataaaataatctatataaatttatgtcgttctatttttgaagtaactgtcagaaccagcccaaatttatgtggttctgccaactgaattttaatgtgaaatatttgtaattattcaactgaatagttacagatattttaagagtatagaagaaaagcggcttcaaatcaaaacgctttgaagccgctgataaacaagatttaactatgccactggatgtacagagcactgttttttatctctgccttttctttcgaaacgtactacaccatctactaatgcaaataatgtatcatctccaccgcgtcctacattaacgcctggatgaatctttgtaccacgctgtctgtaaagaatgttaccagcttttacaaattgtccgtctgctcttttcgcaccaagtctcttggactcagaatcacgtccgttctttgtggaaccaacacctttcttatgtgcgaagaattgaaggttcattttcatcatagtcgttacacctcccttgttataacttttaaccagatatcatactgttcttcaatggaatgtactccaagatcaaaggagtccatcaataacaatgctttgtcactgagaggattcttaaaagtaacctgaacaagtccaagttcttcctgttctgtcacttcaaactcatcatccgtaaaagtatctaaactattcaccagattaatcgtaagaacagaaacggaacagcagactaaatctgctccctcttccacactgtcagcatgaccaattacctgaaatcctttatattgattatcaggttttttgtagatagtaatctgaatcatatctctaccagtttttgtttaacaaactgtctcgtctgttctgctcacttaaccttaattaagcattaattttttcaatcttaactttagtataaggctgtctgtgaccctgttttttgtggtagcctgtttttctcttgtacttgtaaacgataacttttttgtctttaccgtcttcaactacagaagcttctactgttgcacctgcaacaacaggatctcccactttagtctcttctccgcctactactaaaacctggtcaaatgtataagcagatccagcttcaacgccaagcttctcaactttgattacgtcgccttcgcttactttatactgtttaccacctgttgcaataatagcgtacatatggcacctcctaataattactcgccagttttggtgttctgttatgaaacttataccgaactgtgcggcatacggctattatgataacagtcatttctttaattgtcaagcatttttttaaatatttttaatttttcttttttcaagcataaatcttttggcatttaattcaagtttgtaatcccttaaaagaacaacagcatggaggaagttaaaaggtaatctgtatactcaaatttcaaacgcatcagcttctattatttttcatgcaggatcgaatctgctcgtgaagaggctttcttaccttacttctggtcatttctacaagattaagtgcggtcatgtcaatgacattacagtgtacacggtcctttttacattcgctgtctaataaagagagcagtttttctttttgcgccgtatctttcatattaatgaagtcaatcataataataccagagatatttcttaatcggagttgtctggcgatttcttttgcagcctctctgtttatctggtaaaaaagtgtatcttcctgtttctttttctttagaacacttcctgtatttacatcaataacagtcatggcttctgtatgttctataaccaggcttgctccggattttaaccagatatactttccgtaagcttcttcataataatgggcaaaacgatataaattatataaagaataggtatcttcataaaaactgatttttgttgtatcagactcgcttgtctgtttataatattccttcagttctgtaaaaacttctgcatgatctgtaagaatttcatccagtgcttttgccggaagttcttttcccaatgtaatgtaatgaggtggttctctgtataaaagagtctttccagtagcaatctttgcctttctcatcagttcttcataacgtaactgcagcaattctaattcctttgtaagagtctcttctgaaacgcctgctgcatttgtccgaacgataataccatactcctctcttgtatatttttttagaagagtttctaaccgttcccgttcaactgtatttcgtattttttttgaaatgccagttcgtttatctgtgagagtgaatacaaaatatttaccatccagactgatattacccgttcctactggaagctttgtctttacagcatcttttgtgatctgcaccaaaataatatctccgccgtaaagcttatcctcatggcccggtgataattttaccggctgttctgctgataaggaatagtaacatttctggttatctcctatttctaaaaatgcaccgtgaatcccttcggcaacacgttcaacacgggcagcataaatgttgccaagaatgctctgctgttctttaggctcacagtaaagttctgtgggaactccatcctgaaaatatccataacagatgactccctctttttctgtgattactaatttatttttctttatttccatgtatctgacctcaatttattatacttgtaatgcattatagttgtctcataggcagcttttttatatagaaaaatatataaaagctgaacgattgcttcgtattattgctgttatactaacaaaaagaccgatgaataacattcaccgatctctttgttagtataaggattagattatttttaaatatatactttaatcttctggtattttacaccatgtgctgtagcttttctgtgacttgcataataaacatcaattcgtttacctttgatggcacttccagtatcttcggcagtataaataatattaccaatcttaacctttgttccaagatgaataagacgcttgtccacagcaatagtacgtttttcttttggtcttgttccactggcggtcgcacatcctgcccactttccggcacagcttctgcaattacagtaacctgttgttcttacacgcatcgttatgtaattctttaccgttacaacgctctgtgcatatacattcgttcctgcaatcttcgctgtgattactgcagttcccttgcctcttgcaatgacctgtccattacggtttactgttgctactcttcttttgctggacttccatacaacctttttagaacggctgttagaaattctggcttttaacttcactttctggcctcgctctacaacggaaccagctttatttaatcttatagaagcttgtgattgaacactcgcctgtgtattattcgattttgtctgctgtgcagaaactttctgcgggaaaaggcagagaaagcttaacataaagatgaacgttgcaatgatgttatactgtttacacttcataatagacctccttttcgtctttccaatttctattacgaaatgtattataacatacttgttgcgttttgttaaccctattttaacaaaaatattaattcatttaatattcttgtaacattttgaaataaagctttattaccattgctataaaaaataaaatttatacatatatttattgcaaaatacagcatagttttgtgcgtaaacaaatacacatatattactgcatgaagattgcagaaattatttttcaaacacgctctagtttttctgttcttcgtctggatgtttttcttcagtaatttcccagccgacagaacctaatggctgaagttctccatcttttttcaaataggtttccaaacggtgatactggaatcccatcgggtcataatcatagccaagatatttacaaaaagcttccattacaagctgtggctttaagttctctgcactgccggtaacaagtttcataaaaatgccttcctgttttaatggaagtcccggcagaagcggttctgattcatattcacgaatatcaagaatcatcggagcgatatctacttctttttcagaacgttttgttttctttacaataggaattttttcctgcatagaaaaaggctgtgtgcgttttaaaaatgcatctttgtaataatatccctcacggaatgtcacaagataatctgccgcagccgttactgccatacagtttttctctttctcatcaatttccttaaattcaaggacagaaatcccctcattcattaccgcattgatacgggaaagcatctcctcgctactgtaagtccagtcaaaagaaatatccgcatattcgccttcactggtcatgccaagtcctaatggggcggcaaaactcataatttgatgagggctcatacctttagaaaaagaaactggcagttctgcacgcattaatgctttttgaaaatatctctgtacatcgagatgtcctataaatttaagaacacctgttttcgcccattttactcttactttcatagcagacacctcctccaaattttgcagctccgcagccggaacacttctgacggcagtttggtgttaccttttctgccattgcgttattccattcacgttttaaaaattcttttgttacaccaatgtcaatgaaatcccacgggaagatttcgtcaagttctctttttcttgttgtgtagaaatgatagtcaagaccattctcttccattgtttccatccaggcttcatagttgaaaaattctgtccaggcatcataaatacagccttttttataaacatcgtaaataaccttgccgatacggcggtcaccacgggcaaggataccctctaatacggtcgttttggcatcatgccatttgaaagaaagactgcggtgattatgctgaatcttaaattcatcatttacgatatgtgcctttgttttgtattcgtcctcctcacacatagaagcccactggaatggggtaaatggctttggaacgaagaaagaagcacttgcacctacggaaatacgtccatgacggtactcggcatccatgctgtaataattcatcgcgattttctctgcaagatgagcaatacccttaatatcttcttccgtttctgtaggaagtcccatcataaagtaaagctttaccttgctccagccacctttaaacgcctccatcgcaccgtgaagaattacttcttcggtaagtcccttattaattacatcacgcattctctgcgtcccagcttctggtgcaaaagtaaggctgctctttcgcacatcttgtactttactcataacatctaatgaaaaagcatcaattcgaagagaaggtaatgcaatattaatattcttagaacggtagttatcaatcagataattgcaaagttccggtaaatggctgtaatcactggaacttaaagagcttaaagaaatctcgtcatttccagttcctttaattcccttagcagcaagttcttctaacattggaagagagcgctctcttaatggacgataaatcattcccgcctgacagaaacgacagcctcttgtacatccacgctggatttcaagaacacagcggtcctgtgttaccttaatgtatggaacaatctgtttctcaggataaaatgtgttcgtaagatccatctgcacctgttttaaaatcgttcttggaacatcttcataaagcggctcaaaagaagcaattgttccatcttcgttataagttgtctcataaagagatggcacataaattcctggaatgtgggaagcctttcttaaaaattctttacggttgccgccgttcttcttatgttctttatataaatccataaggtcataatatacggtttcactctctccaatataaaacatatcaaagaaatccgccaaaggctctgggttataagtacaagggccaccgccaataacaaatggagcatcttctcttctatctttcgcataaatgccaatctgacttaaatcaagtatctgcaaaatattagtgtagcacatttcatactgaatcgtaaccgccagaaaatcaaacataaatacagggtcttgactttctaaggcaaaaagaggtatattttcctcacgcatgactttatcgaggtcaacccacggtgaaaatacacgctcacagtatacatcatccctgcggttcatttgatcgtaaataatcttcatcccaagatgggacatgccgatttcgtacacatccgggaagcacatcgcaaaccttattttcccttccgggtccttccttaccatgtttacttcattcccaatatagcgtactggcttctctatttttagcaatatttcatcacttaatgctaaattattcatacattttcctttcgttattgtttatttttcacaaaacatatatttgcttaaattttaatatttaagtgatttttaatgtgaatttaaacaaatttatgcgtcagtttttctataatatcaaaaaaattcactttttgcaaattccagactccttaaaagtatgtggactaaaaaaatcaaagcacttcttttttataatgcaagtatgttctttcgtctttttattatagttaattcccacaagaagaatatttccatgataatctttcaaagcatcggtatatttcttgtcttcaatctgggcaattgctccctgtacatttttatcccattttaactcaataatcattgcaggtttatccatatatagccctcttgggagaaaacaaatatctgcaaatcccttaccagtaggaagctcttttataagtgtgtaatactctcttgcgaagtaaaaagccaatgttatcgtacagcagacgcactcaccgattccattacttctgtccaatccattgtgctaatcatggcatcaactacagattttgggttgtacatagaataaatttgtagcagacgttctttcgttctggtaagtctgtagccatcataccaaacttttgtttcttcgaagtttcgtttatattgtttacataattcataaacttccttttctgtaaaaccaaaaaattccgtcatttctctgggatttgtcatagaatactctgcaaacatatttagtgccgaatgagaaccgtactttttaatcggtaaaattcccgtcatatatgccagtgctacataatctttatcatataacaaacggatgatttgtatgcataaaaatatcctgcattacaaatacaagatactcgttatctacataatctggatatttcaattttaattcctttattacccttttttgtaaaatagcaagcatttcgtctatatcgtgtgttgcacttaaaaattcttgcatatttattttaataacatcatacttatttttgtgtttctgataagaaggacagttctgtataaataaattatcaaaaagttcagaggtatcttctgccgtatcataataagcagccagcatatttgctgccattgattttccgaaacgtcttggcctactgacacaaacatatttttgctctgtacatataacatcatttgttttggctattaaaccacttttatctacataaatttttgaacgtaaacttccttgaaaagatgtatctcccggattcaaataaattcccatagtaaacctcctctcaaaaatcttttgttaaaactagtatactaagggattcgtaaattttcaatgtattttatttacgaacgaaatttaattcagattatttgcaatctgcttcctgaatgtatataaaattgagaagatgcacatcatgcaatgcatgatgtgcatcttacagtaagaatacctcggtattgttgaaaagataactatgttactgttataacctcctgatagtgccctataataccgtaatcggcatatttaaaaatcaaggcatctttatccgagttgatagaaacgatacattcacttttttctattcctttaacaaaagcggctaggcctgaagccccaataacaatgcaaagttttggtgagatagattttccggaaattccaatcattcgttctacaggaagcagaccattttctactgctcgtctggttcctgcaatttcagcattaatttgttttgcaaattgctcaatgagaggatatccatttttatctacaccatttccaataacaatgattttttctgcctgctcccatccaactacaatatttttattttcctttgtatatgcagttatatagtcattggactgtatttctacgggaattgctttccacgctggataacaaacttcatcgtatgtagccggaatattttttgcaagagtaattatcctatgatttgttacaggaattgctttggaaatattaccaagaaaaatatctttttcccaggtttttactgtttccgagaaaaagctcccttttatattagttgctaaatgtgttttttcttgaattgcatattttacagcaaaacttctagcataaactgtagttccaaaaaagatataatcgtatgcattgattcggttataatcttttatgacatctaatatagaggtatcatctgcattttccggtaaaaatatataataaaaatttatatttttcggagcattaacctttttaggaagttgttgtttcggtataaaaatgaagaaatctatcttcatttttaaaagttgtttttctgtaaatgcatcagctaaaaaagaggaaacggccttaatttcatggtttaaagttgttttctcaccaaaaattattactgaaatagacataactaatttcctccttccctgttttttaaaaattgattccattcttttacagaaataaattgacagtttctcttatgttgccgaagagaaaatattattttctcttcttccaattccttttcccaacatttttgatgaggaagttgctgaaggaaaggtagtttatcttttcttcttggtgtttttaaacgaacatccggtgcttcaccaattattaatactacaggcgtttttacggtagctgtaataatcgcttcatcggtgtttcttttaatccaaatatctgtattattttctatatgaaaatcaactacattggtaatacaaggataatgcataaattccgcaatctggggacctgtagttccatttcttcgggatgagctttcctgtccgacaatgaccacatctacatttccctgttctttacaatgttgtttaaaaacttctataaagtccgcatttcctttagggatatattgaaaaatttcatgaaaaccatgtgcttttaaattttgaaattcttttttgatattttcttttgtcataaacaaaacatcagcaactatggtaggattcgattctaaaattcttcgcactaattctaatcctatttcatcatagctatttttttcatatccgatatatggaagaaaacgaaggtattcctcctctctctcccatacatcatcgggaatactattatattctgcttccattagacaacaatttaatattttcattaatctcaccacaattcattggatatatacagagctttttaaagttatgcatattttatccattttagtgaacggtcaacggcttctttccatatactgtatctttcttctcgtaatgttgcgtccatttgtggatggaatacagcatctggtgttaatatatgctttacatcttccagagaaatttgattaatacttaaagctgccattaaagctgctccaagtgctgttgcctccaatgtatctggtcttgccacatctgcattacagtaatcagctaacatttgaagaagaagattattttgtgacgcacctccatctacattaatgcgatcaatttttacttcacattccttttctacaacatcaagaatatctttaataccaaaagcaatacactctaatgttgctctggcaatgtgtgcatcggtagttcctcttgtaataccgataatggttcctctggcagatggatcattatgtggggaggtcaatcctacaagagccggaacaaaatacacaccattggtatctggaacagaagctgccagagcctcaatttcgccagaagaacgaataatcttaagaccatctctaagccattgtaccgcagaaccggtgacagaaacaaatccttctaccatatatgttaaagtatcatttagtttccatgcaatcaagttatctactccaccagaggcaatcttacaggtattaccgatagtaatatccataaaactacctgtaccattcgtacatttcatagttcctgcttccagacaaccctgtgcaaaaagagcagattgctgatcagcgattgctccggtaattggaatctctttgccaaaaactttagtcacaccatattcagaagcttcggaagcaatagtaggaaatagcttcaaaggtacgccaaggttttgaataaattcttcattccagacacctttttgtacattaacacatccactgctagaagcattagaacaagcaaccgcatgagttttaccctctgttaatttccagatcagccatgtatccattgtaccatataatgcggtttctttttcgattgcttctttaacttctggaacattttccatacaccattttaaaattaatccattattatgaggtgcaatgacttttccagtttcccgcaaaatcttttcttctccaccattttcttttaatttttctgctacatcacctgttcgggtgtcttgccagacaatagcatgatacaaaggttctccggtattcttatcccagattacacaggtatttctctgtgtagcgataccaatacaggaaatatcctctgctgttgctccaattttttgcatagcacccttacatacttccacagatttgttatagatttctgaagcatcgtgttctacacgtatattatccggtgtatattggattagctcctgataatcttgtgatacaattttaaattctttatcaaataaaatgcctcttgttcctgttgtcccctcatcaattaccataatatacttactcataattccttctccttttgtgttaagtaaaaatgacaatgtgtttcttggaagataacactggataatatctatttctctaccagtaaatctcctttatttagaattccatttggatccatcgcatcttttaagcgatacattaattcatacgatgagccatgttcttgcggcatccatttcgttctatactttccggaaccatgatgatgtgcaatacttcctccatatttcaatgtttcttccataataattgttacaatcttcatataatcttcttgtacataatctaccccttgtccgcctggaaaataaaacgacagtaaatatttgttccattcaaatagctatgagaagaatgtgcccctacaaaagtaatattttcgatttcttcattgattcgagaaataattccttcatatatttttccgattacatcccaatttccagaaatttctgtagtatcagaaacgattccttttaagtatcttgtatttttatcaatatttgcacagctgtcatttctagtctttaaccatacctctaccggttctgtgcctaaatcaagaaattcatatttttctgccagcgattgtatggcttctcctgtaacatccgcaattgcttttggtccttctgcgataaataaaagcatagcataaccttctggagccggagcacccattaattcctgtacttcatattcatcatgaagacgtaccacggcaggtttatatccgctaaccataatttctcggataaaatccagtcctttttgcattccaataacaccatatgcatgcatccagcggttttccggatggtattcataaagtttcatagaaacttctgtaataaatcccattgttccttctgaccctataaaaatatgtcgtaaatctggtcctgtagaacgtcttggaacatttttaattcgtacaacacttccatctgcaagtacagcttcaagaccgataatacaatcttctactcctccatataatgtagaaaactgccctatgcttcttgttgctgttaatccacccaagctggctaaaggaagagattgcggataatgtcctgtagtatatccttgtttatttagttgttcttccagatattccaaaggagttccacattgtgctgtaacaatatgattttttttatcgatatttaaaatatcacacatatcacatccatcaataattacaccaccttctgctggttcaatactcattgttacgctagaaccgccagttcttggaactacatcaatatgattttcattaaggaaggacagaacttttgatacttcatctgtatttttaggtttaatgacgcacatagcatgtggtgcccagttttttccatcagagcgatggtatctacgaaatccgatataatcgcgtgatgctaaagcaatactttcttcatcagtaataactttatcctttccgacaatttcttgtaattccttgatgatttttttttgttgcataatcttttcctcctgtttttgtttcaaatttgtgatattaagaaataatctgctgtaatttttttaacagctgttcattgattttataatatggattaacaatttcttccatcaattcctgatataatttatgattttcagttgaaggaagaaattctgtatgattttgtcccattgcctttgccgcagcataaaaatcaggaaaacatcctgcacctactgcagcacaaattgcagcaccaagagaacaagtttctggttcttccgatttttttacggagagattaaagatgtctgcgattgcctgaacagccacataacttttactcccacctccaccgacacgaagttctttaatttctcgattggtagaatggcacatatcatctgtaccgattttcaattgcatcataattccttctagaagggagcgaaacatatgtgcccgtccatgccgcatatcaaatcccataaatatacccttggcatatggtttatcccatgtacttttccaatcaggaattgtaatcaatccctctgcaccaggagaaatatgtatggcctcttcatctaaaagttgttcaattgtttttttcggattatctttgtttagattttttgcaaagttatcccgaaaccaagatattagccaaaagcctctgggagaaactgcctccgcattccagaatcctggaacagcagcagtataagtacgatgtttcgttaccttatattcatctgcaatatattggtcatcaacaagattaagaccggtcatcgttcccatcgtgatgtaagcttgacctttatttaatgttccacttcctaagatttcacattgtttatctccagccccggcaactaccggacaaccaacaggaagtcctgtttcttttgctgctttgtttgttatcgttccaataatttctccaggatttcgaaaagtagccaattgactacgagtaatagccattccttcataaacagcagaatcttgatataaattccaatgttctctgtctacaggcataccaagattatttcctaaagaatccgcaaattcgcccgtaagtttataatgaatatatccagaagtagtgaaatatttttctactttttcaaatatatcggggtactctctctgcatccaattcattctggaataatttacaagaaaatattgccatgcatctaaattgtctttccatttatcactatatttttcatttgattgccaacttcgatccatccaactgattggacggcatagttgttgcccttctttatccagaaaaaatacggtagctctttgtgctgcaatgccaatagctttaattgttcctgttgcagtttcggaatttttctttattttttctatcaatatttgacaagctgtacaaagaccttgataaacatcttgataatcatggacaatcaatcctctttcgtcagtcatcaatgccggatgtgtagctgatgcactggcaattttttcaccttttaaattaaataaaattgcccttgtactttgtgttccactatcaataccaattacatattcctctgccatactccgtacctctaattttttattttttctaaaatgtttgtatcttttgctgtaaaatcaatttctgtacaatcttgttgttgggcttgtgctaaaatctgaagtaccacaggaagacaaaatcctccttgacatcttcccatacctgcccgggttcttctttttattgcatcgacagatgttggaactacaggactgtctatagcatctaaaatttctcctttagtaatgaattcacatcgacatacaatttgtccataatcgggattttctttgattaacttattttgttcttccaagcttaattttcgaaataccctgcgctttggacgatatggttgataatttttttttcttttataagacataccttctttcttcatttcttctaaaagaatattttcaaccattttagcaatagccggtgcagcactaagtcccggtgattgtatacccgctacatgaatcaatccggaagtgacttctgatttttctataataaaatcttccttaaaatctgctgcccgtactcccgcaaaagaacgaataacatctttttcccctactcctttatgttggcaacaacttaaagcataggcgattccttctgcatcgcacgaggtatcttctttgttccatacttcttttgcagacggtcctaaaagataattaccttccggtgttttacaacatccgccgcctttagattctttgttttttacattcatcattcggttctctaatttattactgacaaaacctaattgtggtttataaggatatgtctttgctttgtcaagaaggacaatcgttccttttcttggatgtatggtataagaaacatcccctgccattcgagaaatatcgtcagcgtaaactccggcagcattgattacatatttggtttctatgactcctctactcgtaaccactgcttgtattcgtccgtcgtgtacaatgtcacatacttttgtgtttaacataaatttcacttgattttcagcagcattttcagccaaagcaattgttacttcataaggttctacatgtgccaaactaggaagccaaacggctgcaattggggattatctaattttttaagttcaggttcgatagccattgcttcttcacccgaaatataccgtataccatctactccattttctaagcctttcgtatatcgccttttcaaggccggaagatattcttcttcccaggcaatgtacattagcccatttcgctgaaattcaaactgtaaatctttagcccattcatcgtacatacgatttcctaaaatattgagtttatgttttaatgttccctttttcacggcatgtcctggatgaatgtttccattatttgcttttgatgcacccacagagacatcattttctttgtctacaacaatacaatgaaaatcatattttgataactctctagcaattccacaaccgataacacctgcaccgatgatgacgacatctgttttttgaatgatacctttttttctaccctcttttgccatagatgcatagtcctgcggtgtaatagtcagaccttttaccgtcatttcactgacaacattcttaatttttgcatcttctgcaacaaaatgtcctacatcaatcaattgctcccatgtttcacattctcccgatactgttgcaatattcctttcattaattcttatctcaatattcaattcgggaaacttatcttttactttttcatttatcctcctatttaacgtattcataaaaatccctctttgtctttcaattagtgttgttcgttatgtctattattataagaaaaaatgtccgttttgtcaataaatatttccgatatgtccgattgtatatctttcttgtaacaaacaggacataaatctcttacaaatttgtttcttgttttatgtataattgtgttataataaggaaaaaattaagaaaagggtgcttatttatatgaagaatcatcggcaggaacaaatattagaaatattaaaagaaaagggaaaagtgaacgtacataatcttagtgagtatttttctgtaacacctaaaacaataagaagagatttggaatttcttgaagaaaatggagaattagttcgaatccatggtggtgcagaaatgacaaaaacggatatattaagagataaaccttttggggttcgcctaaacatagaagcagaaaaaaaagaaaaaataggtaaagaagccgccatgcttttaaagaatgggcaacgaatatttatcggtgcaggttctactcttgattatctctcttcttatattgataatacaaatcgtttgtatgttgttacagattctatcactgttgtgaatcagctcaataatcgaagtgaggtagagatttttatgattggcggtgaaattacaaagcacatattaggagcatctgggacgattgctgaaaatacattaaaaaatttttggtttgatatggcatttatatctgcatcgacagtagatcaagagggacatctttttcatcgtggaccggctgaatttggtatttataaacatttagcggaacgtacaacaaaattagttgctttaatcgattcaaccaaattaggaaaacataattttattaatgtagcaaaattaaggaaaaatgatattttgattacagatgaggatgctgacccggcttttattgaggcattgcgtttacaggggatagaaatcattattgctaaataaagaagtcataaatcctatagaaattaataaaagaagagatttcatgcgagtgcatgaaatctcttctatagggaaagtgactctagatgccttttccttttatgttattataggggaaatgaaaaaggcgatttctagaaggctacttaactcttattactttttttacttccggaccattaccatatcctttacctaatgctgtacgaatccgaatcgttaacttcttacccttttgtgctccgttaggaacccatacggtatagctctttttacttccttttacccagttattggcaacccacataccgccgattttcggtacttttttctttaaggttacttttactttatacttcgtataggtatacggtggtacccattcataacgtgaaatgtgtccgccaacccagtgtttgcgccaccagcccttaacggttacctttttcctctgtacgatttttatagactttaccgctggttttactttagagccggtcttcattgttacgatattggatggcgttcctgtcataccgtttgcataagcctgtacacggaacttataattcgtcagaggttttaatcctttgattgtcactggattactgttgccacaggagaagtatcctatcgtttttgctgtcgtccattttcctttctttaaaacctgaatccttacagaagtctgcagcttatttggataatcaatccagaactttgcagaattataaccggtagctacccgaggctttttcaatttctctgccggactgattacataggtggtaaatgtctttccgttagtagtcttaaaagtgatccatttatgtttgcccggtgcagtagcagaagatggaattccgtcataatcaactttattcgaattataccagtcccacgtctttccggtaagatggtcatataccgaaacaatcttatcatcggaatttgccggtacagtctgtgcgatcacctttttcttacctatatcggaaagctggattgcactctgtgaacaggtaactttgttagcagagatccagttgtgaccgtttaggttaaacataaatgttgccggataataagcacccctattagctatctgtacataatatgtaccgcttgttaaagtttttgaacccctattccatatgttctcgcctttatactgtgtagcggcttcgctgtacatcagttcgtcacgagaattatatattttgataaatgtttgattctgatgaaaaaggttgcatctttctttttcagccagctcaaatgtcggattaattacagctctttcgcttattttataattacgagagtggagttagctacgtagtaattcgtaacatcaagtcaggggcaaaataccatttaccaagaggatggatttttttccggactgcttgggataatgaagtttttattggtgactgcaattgcgagccttgttttattggcatagccggtttttgataaaatgttagaaatatggaactttaccgttcgttgtgatatatgcattcgttcagcaatctcactatattcaagaccttcgcatacaagccggagaacttcgatttctttagcagtaagttctgaactgtcagcaagacccagctttacgctaggtgttttgtctgggaagatatgttcacctgccatcgtttcctctataacatcaattagtttttccggactgatatctttataccagaagctgtcggcttttgcttctctcgctctttttaaatatccgacttctaccatcgaagttacgataattatttttatgtccgggaattctgctttaatttctgctgccgcttcaataccgtctttattaccggcagtacacacatccattaaaatcaggtcaattttctcccgcctgcatacggcaagtgcgacatctgctccgtttacactggcacaaagcttatatttgccactatcaaggagaatcctttccatgttttcacgaggcatcctctgatcctctacaatcaataccttcttcatgatctagctcctttttttgaaatgttattgttaatgcaaaatatggcatggactgtatatgcatttccccactataatcaaatatatgacgtgaaagattatataagccgccttttggaacaacttctttttccggaacttccccattatttgtaatacaaatatgataacaatccttatcttcttgcatcgttataaaaagctctgtcgcaccggcatgacatactccgtttgtcagacattccctcatggcaagaatatatatgtgagcatactcttcttcctttggtaaggagccggtgcagcgaacctttacaccgattgttcgggcatcctgtagaaatctttcaaattctccctcttctaaaggatattgattatcattccagatcgcatttactgcctgacggagtaatcgcaccgcattgctgtaatctgcattttcctgtgctaaactttgtcggatagcggttaatcccgctcccatctgatcatgcaatttagtcttggcagcaaggacttccctttctcttgtcaaaatcaatacattatcagaaagatatcgtagctctctggatatttcttttaacttttctgtttgccttgtaagatttattttttcatgatattgctttgtgacatctgaaaaaacggcttctatatagacatttccctctttgtctttcacctcactttcctgataattccatgctcgtccgtcaggaaaaagataaatctcctttttatctgtaaggcggatgatttcattttgtatattgctgtgaagggcatctcgtaattcactaagtttttgcaggtctttttgagcaagtgttctaaaaagccggtacatctgtgaattacagagctttattgtaccattcaaagtaaaatagcagattcctactggaagaaggttcaacgcttctttaatggaattttgactaaccttctctttcgttttcttttttaggtggatactctctctaacaagtaaaaaatcaataataccgacaatgcaccaaagtatcacgattgggacaggcagcaatttataatatttttcaccattatttatctgatggaaagaatatgccagatgattcaaaagcagaaataaaaagaagaatagaaagctgttccaatttcgatagcatttccacatatatggtcgaagttcataaagaagaaagagtaaaagaagagaaaatatcagactgagaaatactacggccataaacatcgtctgtagtagcttatatgacagatagaatgtctgcattacgcttcacctgctttcttcacagtaaatgtaaatctccatactccgtcctcgtaactgctcgtatcggtgatttcaaaaaatgaggttaagtttgcgttgctttctacttccatacaaaaaatcagactttctttatgtacacgaaactttacccatacagataaaagggaatcaagacaagcttcgattacggtttcaaaaaagttataaatacggacggcatcccgcacatagataaatgctcctgacggagcggcaaatgcacacataactcccattagcctaaggctgctaaaagactcctccagacaggcttccagttctgcgatatcagacacctcagctctttcttcgataaaaattaagttaccacatcgctttatgtaagttccaattacactgattttagcaagcagcctgcgtttcgctgtcaaatttgtttccgcctcatattgatataacaagttatttaatagttcaatctgcccggcagtttgcatctgaagcttatcgtataagcggttcttttcccggagcatattaatctttgcttttgtctgataattctcctgctcaatgcagttactctcttctatcgttttccggttttcttccatcttttccaacagcatcaggatgtctttaatgtcctcctgccataaaacatatcctccctgaatcggcctgcttttaattacggtctttttatcaacaacgacttctttctttgcagactctttcattatagtcttagatagttccattgcattagaagaagcatagcatacatgatactttaaatctgtgatctgcgctcccatcgtacatacttcaaacaattgttcatatcctgtatttgtctgaatcaggccacagtaaatacagctttcaaatatacatacaaacatcagacataaaacagcggtaatatctccgccgatgacctgcatccactgtacgccacttgcataaataatggcatagatgatagtaatacaaattcctataacgggaagatacttctttctctgagatagtcggcatttataaaccatcaaaataaaagcagataccccacataggatttcccagaggagtacgatgtaatagccgctttcataacaataagttttatctgtccatatttctcctaaaggaaaggaaaatacccgttgatgaaaatcattggatattacaagtaaaaaacagaaaatggcaggaagatatattaattttgaccatttgggtaaagtatactcttccggctgtccaagaagaatcgctgcctgtagtgccgcctgtggaataaagagcataggcagatagtagctgtaccacaaatagcgttctatgttggcatctattgtaaaaaagtactttatagtgcggataataaaccagaaaatcattaacccggatataaggagaatggtatttttcactgatttttgaacgactcgtttatggatgcttatcgcccatccgatatataatccaatgtatattatacttcgtacgattccatttaaaacatactggaaacttattttccctaaaatacggcacagtagtgcaatgagaaccatgcatataaaaataatgatatttctgtttgcctttttttgtaatattttctgcatcacagcgaaagtgctccacattcattttcacgattcgtcaaaatcccaagcccgtgttctaaattcggaagaagaaactctaaagactcctttactgcctttggactgcccggaagattgataatgacagtgttgttacggattccggaaacagcacggctgaacatggcacgaggggtaatcgccatggaataattacgaatggcttcagcaattccgtttgccatgcggtcacagacggcgatagttgcttccggtgtccggtcacgtttggaaaatccagttccgccagtcgtaaaaataagattaatctggcgctgatcgcttaaacggatcatttctttttcaagaagcttttgttcatccgcaagtaaaagagtttcttttacatcgtatcctgcagattttaacatttctacgattgcaggaccacttttatcctctcttaatccggcagctcccttatcgcttaaagtgattactgctgctgtataaggtctgtctgcttttggagggatgcaggtaacttcctgaccgattttaatatgcccacctgtaatcacttctgcaaatacgccttctcttggcatgatgcagtccccattgtcttataaatcaaacaatgattatgacattcctttccaatctgggtcatttcaagaacgacatctccgataacaaaacgggtaccgacaggcatagaactaaaatcaatcccctcaacaattaagttttcaccaaaagaaccgggatggatatctgcacctttggctttaaaggcatccactttttctttggaaagaagactgatctgacgatgccatttgccaccgtgagcgtcgccctcgattccccagtcgcaaacaatattagcttctgttatgagatgcttttgcacccctcttttttcactgatacaaattccggtaattttccccatattaacttctcctctcatccgccaatctagagcgtgtttgaaaaatcattcctgcaatctgcacgtcccaatttgggggagattttgccttcattcagttgccgtagcccgctacgtcgccctcattcaggcgaaatctcccccaaattgtaacgaacatcttacagaaagcatttttcaaacacgctctagcccaataattttaataatcgttctcaaaattatatcatatacttttacaaaaagaaagatatgcaggagaaaaacacactatgccctcatattcatcatagattgacatatcatcggtacttagatataatcacttaaaaagtgaatatttatcgtaaatcacatataaatgaagtatacatttatagcaaagaatgaatcaattatatattttaaagaaaagagagaatattatgccaaaaggttccgaacaattaactaacgcaagaaaagaagaaattattaacgcctgtgcaaaattatatacgacgatgaactttaaagatatcactttaaaacagattagtcttgaaacaacctttacccgcacttctatctataattactttcagacaaaagaagagatttttctggcactatttcagagggagtatgacttatggacagccgatatccgacagattttcgaaaaatatgaagtgatgactgttgatgaatttgccagtgccttagctcatactttagaaaaaagagaatgtctcctaaaattactatctatgaatcattatgatatggaaagccgcagccgtttagacaatcttgtagaatttaaaaaatcttatggaaactctatggcagccgtaacacactgtcttgaaaaattcttccctaaaatgacgatacacgatattcaagactttttatatgctttctttccatttttatttggtatttatccatatacttatgtgacagaaaaacagacagaggcgatggaagaagcacatacagaatatgttctgttatccttatatgaaattacttattcgtgtattaagaaactattggcagatgcagaatagggagttctgacgcaacagatacccataaaaagcatatataccaactgacccttattagatacaattcaacccccgatctgccccatcggatggctttctgtcacttgcctcgtatcttcaaaacaatgcatttgcggcttattttcaatactttttcttaatatattttgaatttcttcctgtcgtttttctggattttccattcgcaaagcaggttttaaagcccaacgctgttcgtagcacaggcagggttttaaatctccagttgaagtcattcgaatacgattacagagattacagaactttccatgcattgcactgataaatccgacatttccctgaaatccttctatagagtaatatactgccggaccattcccatatactcggaaatcctctgttaaatttccatagtgttttcgtatcgtttcttttaactcctcattagaaatgctttccgacatatttccataaccaatcggcatcatttcaataaaacgaacgcttaacggtaattttcttgcaagttccgtaagaggaagccattcttcctcattcattcctttttgtaaaactgcattaatctttactggaataccagaagctactgccttttctatagaagaaaggacaacagcaagtttatcaaaaccagtaatccattcatattttttgatatccaatgtatcaagactgatattaacggcatcaagtcctgccgataataaagcttctaattgctctcctaataataatccgtttgttgtcaatgtgacaagttctgttcccggaatattttttatcatgcgaataacctccgggcagcctcttcgcacaagtggttcccctcccgtaattttaaaacgggtgatgccaagctttactgcttcctgacagacctctgtaatctcctcataagtaagaatctctttcatcggaatccattcagctccgtctggcatacagtaacgacagcgaagattacagcggtctgtaatggaaatacgcatataatttatctctctgccatagctgtcttttatccctgtttttatcattataaaaatttccttttactctccatttgtttttggcatatttttaaattcaagaaatgccatgataattgtaacaactgctgctaaaaagtctgcaatcggtccacagtaaatacatccttctattcccataaaatgcggcagaattaaaagcagcggaataaagaaaatgatttgtctcgtaagagataaaaagattccctttgccggctttccaattgatgtaaaaaatgtggatgtaattggctgtaaggcatctaaccagataaagaataagaagattcgaaagaaacgtactccaaattcaaaatattctggttctcccgttccaaatagtccgagaatctgtcttgggaaaatctgaaacagtacaaaagaaacaatagaaatgataactcctgatgttgctgcaagaccaaatgccttacgcacacggtcgtaattctttgctccataattaaaactttctactggctggcttccctgagagagaccgataacaatggagaaaaagatttggtttaccttaatgacgattcctgcacaggctaaaggaatcgcttctccataaacagaagccgctccgtagtgagtcagagaattattcataataatctgcacaaccatcatggcaacctgattaaagaaagaagccataccaatctgtgccgtcttgctgatatattctatctgcggacggaaatgttcttttgtcagagaaacggtcttgaaatgaagcaaataacgaataacaataatcgctgaaataatctgcccgataattgttgctaaagcagcacctgccattccccagtgaaataccataacaaatatggcatctaatactgtattaataactgcaccaattaaattacagagcatcgccatattgggactaccgtctgcacgaatcagatgacatcctcccgttgtcaaaatcaaaaatgggaaacctatcgctgtaatccgcacataggtctgtgcgtagggaaggacattttccggagcaccaaatcccgttaaaagcggagttaaaaataattctgcaatcaaaaataaaattacaccgctgcctatcagacaaatgatggcatttcctacaaaataaacagcccggtctttatgaccgcctcccatatttaaattaaagcaggaagcaccgccaataccaaacatcagtgcaagtgcaatacaggatgtggtaagcggaaaggcaacatttgttgcagcattgccaagtgtgccaacagcctgtccaataaataactggtcaacaatgttatataaggcactgacaagcattgcgataatacttggaacagcaaacttcaccattaaagaagcaacggaagcttctcctaacggattgcctgtctgtatgttttctttacgttcttcactcatattttcatctccttgtctttgtattttattattttttattgcataaaaggcggctgccttctttgattcagacagccaccttttattatagcattaattttgtgaaatacacaaacaaatatttaaattttctattatttttgtttattcggttgcctgaatggcatcatatcccgtttcttttgtacgaatcttttgtgcatgacggatttcataagtaaatatcttaccatctcccggctctcctgtataagcagccttttcgattgcctcaattgtttttacttcccattcttcggaagataccactatttcaaactttatttttggctgcatctgcatatctacctgcataccacgaacaatttctttataacctctctggataccgcagcccatgacctgagatacggtaagaccatttacaccaattgcatttaaagcggctttgacatcttcaaatttatcttctctgacgtaagcctcaacttttatcatcatgattaagtcctcctgttttcataattaccaaaattaccaaatgaacgattaaataactaaaattactgatcaagaccattgaaagatggatatgcgttttcaccatgttcagaaatatcaagtccgacctgctcttctctaacgcttactcgtaatggtgtaaatactctgacaatagcaacacagataagtgttccaacaacggccacagcgatcgtgattataataccaacaatctgtgctacaaataaatggtaatcaccaaaaataagtccatcccatctggcaactggattaattgatttctgtgtaaaaatacctgtggcaataccaccccagataccgccgataccatgacagccaaatgcatccaacgcatcatctatttttaactttttcttgataaatccaacaccaaagtaacaaatcggactgacaagtgcaccgataatgaaagaagaccagattggaacaaaacctgcacctggagtgatcgcaacaagtccaacaacaagtccggtagctgcaccaactaaagtcgtttttccgttctttattgtatcaataaacatccaggataacaatgctgctgccgcagaaatggctgaagtcataaatgcatgtgcagccaggccatctgcttttaatgcactaccggcattgaatccaaaccatccaaaccaaagaagagaggctccgagaacaacagatggaatattatgaatacgataggttgtatgttcataaccacgtcttcttccaagaataatagcaagcactaatgcactgatacctgaactgatatgtacaacatcaccaccagcaaagtctacagaaccgattgccgcaagaaagccgccatctccccataccatatgagccattgggtagtaaacaataacagaccagattgctacaaaaagaaataacgctttaaacttcatacgccctaccagggaaccagtaataagtgctggcgtaatcattgcaaacatcatctgaaaagcacaaaataccaaatgtggaatactatctgcataaggtcctgcttccattccaacaccatttaatccaaaccagcgaaaatctccgataattcctgcatggtttccaccaaaagataaagagtatccaaaaagtgtccacataacaacggaaagacccataattgccacacatgccataattgtgttacaaacattttttcttctaactaaaccaccataaaaaaatgcaagccctggtgtcataaaaaagacgagagcagcacagatcatcataaaagctgtatctcctgtattcataatttatataagtcctttcttctctttttttctgatgattcatcattttaatttgctaaatctcttccggaaaacaaaaaaggcgcctaaagtataattgttatactttagacacccttgtcacgtttcgaatagtatcacatatttaagtgctttgcaagagaaaattataaaaaagcttatttttagttaattttattaataaaatatactattcgcctaatttttcagacaatatgttggctgcatcttctatacagccaggacaggaacgaagtactttaccggtatccatccctttcaattcccgacagattgtcgatccgtttttcttacggaatatctcatttaattctcgtactttctgataagtagccgcttttgaagttggtgcttcaagatttccacaactattagccatacccataacaagtgccataccagtaactgcgccgcaggtaccataagtatcactgacacccagccctaatccttctgacactttaaatgctgttttttcatcaaggcctaccttatcgcaaaatgcacagacaattgcttgcgcacagttataacctttctgatgatactctgccgctttttgtgctcgattcatttgtgttcctccttagtaaatcatagttttttataaattataacagaaatttagatgttccgacagataattttttctttgcgaacagatttttttcttccagcacttttttattattatacattcttctcttgatttcctacattaatcgtctatcggtatgttgaccataaaacaacaaggcgatataataaaataaaaagggtggaggtatttatgaataaatatttaaaacgtactttggttgttgcctcagtcatgattattatattttccataatcatgctctggccgctgcctcttcgcaaagtacttcgacaagaaacagatacggcaatgactgtcagcctgtcagacaatgacacgaatatatcgtccttttctttgtctgcaagttctgtagaatacagaagaattatggaaattctcgaagattattcctaccattgtacctggtacagtttcatccctcatgaatcttttaccggtcatggtgaaaatctgattatatacactggaaacagcggactagtcattgatacagctagcggacgagtttttgtcgatagaggaactgcggaacatacataccgtatgaattatttaggacaaaatgattcggccaaactgacagcacaaattaagaaagtactaaaaatctgaacaatcggtatgcaaacagataaaatagaaagacaagatttatagtaaattttgtgtttctatttttttgtgtttcgaattacattgcaaattacattgaatgaaataaaataaagaaacgctacactcatttttcatgaaatacttatagaataattcttatctaatatttttagtgtatctccattaacaaaacagaatattttcgctctttctatacatactatgagtactaaattttagattttttaaaggagattactatggaatcagatacaaaaaaactgacagatactacaaaacttttaagagaatgtgatgcaggaacaaagatggcgatttcttcaattaatgaaattttagaaaaggttgaagatacaaaattaaatgagattctaactaagagcagaaatgcacacgaagaattagaatcagagattcattccctgcttaattatcacaaagaagaacaaaaagaacccgatccgattgcaaaaggcatgtcttttatcaaaacaaatgtcaaaatgggaatcgatgaaagtgataaaacagtggctaaccttattaccgatggatgtaatatgggaattaaatctttaaataaatatctaaatcaatatgccatggccgatgtgatttctaaaaaaataacagaaaaactgattcgattagaggaaaatctacgaaaagaactttccacatatctttaatatgtgtttgaaaaaatattcttgcaatctatatgcccaaatttacggtatatttcatatccacaacctcatttcttacgataatatgaaatctctatagtataaaatgataaagaaaagcccgtcgaaagcgaaaaaccaaagaacatactcactttcgacggggttatgcaaaatgcaaagtacattctgtattatatgttttttctcatatttttcaagtactattgcacgaaatgtaaattttatgtcttgaacaaccacattttttatattccctgcttgtaaataagaaaaagtattatataatatatacatcatttaaaaacaatgatatattttttaataaaaaatgtattttacatgaaaggactattttatgatttcaattgctgtctgtgatgacaatgagattaccgcgcaggaaatctcagaaaaagtaaaacaatgctgccctattgaagcagaagtttctgtattttatcacataaaagatatactattttctattcataatgaaaacaagctgtttgatattatctttatggacatcgaatttgatgtttcctctggaattgaggcatcaaaacagattaacgcctggcatccagactgtcagattatatatattacaaattatacaaactattttacctctgtttatgagacatcacatatttactatattttaaagaaagatatagatacctatctttcaaccgcattaaaaaaggccatacagcagatagcaaagataacccagtactatttgattatccaatcaaaacagcagcatattcgtattgcacaaagtaagattttatatttagaacgaattatgcgtactacaaatattcataccgcagatacaatctatcagacaccagaaaagatggattctcttttagaacgtttatgtccctggttttgtccatctcaccgaagctatatcgtaaatggacggcacatcgttaatttagaccgtcaccatgctatcttatcaaacgatacttctgttccagtcagcagaacttgttacgaaagtttaaaaaagacatttgccagatgtatatgggcagatgggatgtattttacaaatgaagaagcgaaaggagagctttaatgatgcataaaaaagatatgatttttctttcaattcttattgcctgttcagaatctgtggttctattttatttttgttccgctaagtcacctcgctcattcctatgcatgatgatttcttatgcgattcttcttattttcccattaaatatctttcttgcatctttaagagaacaccggacaggaacttctctttctacgttagaaactacagaagaaagttcaaagcagcaacgcgaaatagaacagtttactcataagcagctcaaacttcataaaaataattttacccaaaaattgaaagaactttacatacttttagagcaaaatgatttaacaactgcacaaaaaatacttggtgaacagattcctcttaaagataccgatatcatttgctgtaccaactctatcgttgatggtattttacaaagcaaaaaatcagaatgtatccaacataatatttcctttgaatatacgattttgtttcctgaaaagaatgatttttctttttctgttttaattagtctgttttcaaatttacttgataatgccatagaaagttgccagatggcttcctcgttaaatcctaaaattgaattatcaattgattataaggggatttcttaattatcttcatgcaaaatacaaaggaaacagccttgatttttaactcattagcaagaaaaacaacaaaatcagattccctttctcatggatttggattatctatcattgaagagattgtaaaatcttatgatggattttgtgagtgggaagatcggggaaatatttttgaatctcgtataatgcttcgttatcttttataataccaccgcaaacgaatatgttttatcttggaatatatttgaaaaatgctttttgcagattgaggtatgcagattgcaggaatgatttttcaaacacgctctaattctaacgattaaaatggtaaagaaaggattttttatgactttaaaccaaatgtttgattttacaccagtttatatttatattgtagcagccgttcagctttttataggattctcattaagttttgccattgggcagattctgcccttgcgtattcgagaatttatgtattacctttttagttttctttttctatttattccttttctatatgaaattgcaacagccaatgtacagtctggaatgagaagctttcttttttacctcgctcttctcatcacaatttttttatttaccaaagaatctttcttaaaaaaattatcgctgttttttatcctggttttctttgatggtatcttagagattgttatttgttctctttactggaaaggaatctgcgaaaaattattcggtcttcactataccccgtatattaatgttcctaatcaaaaagtatctactatacttattttctttttacctgctgcccttgccgaaatagcatttaactttctctttcctctattatggaaaagatatattcggtttattcatctcacaacgtttgtggaaatgattctgcttcctgtattatgtacaaatggatttcttatctttttacctgaattattcggaatgaccggctggattctcttgttttttattctatttgttttaagccttttatttttgcatgcggtgactcaaattccagtcatcttaaaacagattcgggttaataaagaaaaaaagaagcgaattgaaaaacaaatatttatttacaaacaatatcaggaacaaaatattcttcttcgcaggcaaaatcatgatatgaataatcatttacaggcactctcctttttactgtcccaaaatcggatagatgatatgaaaaaatatattaaggagcttttaaaggaataaactgataatacatgtaaaaggcttctgttgcaaaccttctgtcgatttggtatacttaatgtaagtgtagaacacaccagaattgtcagcacaggaggatagaacaatgattaaggcgacaagctgcggtggtgttgtaatatttcggggaaagatacttctgttatataagaattataaaaacagatatgacggatgggttcttccaaaaggaacagtggaggcaggggaagaatataaagaaactgccttaagagaagttcacgaagagacaggagtaaaggcttctgcaataaagtacgtaggaaagagccagtatacatttaataccgcacacgatgtagttgtaaagcaggtacactggtatttaatgatggcggacagctattactccaaacctcagaaagaagaatattttgaagattccggctactataagtaccacgaagcatatcatttgcttcgcttccctaatgagcggcaaatattagaagatgcctaccagcagtatattgaattaaagaaagcgggattgtggggaacaagaaagtatttttaattctgatttcgtttgaataagagacaccctttaaaggcaaataaatccctatctgtgactttaatcgtggcgaggaaaatacctcattcggtattttctcttgctccgagatcacagatagggatttatttgccttcagagggctatctttggctggatttagtttaatcagaatatgattgggggatttggaaatgaggcatataatttaagaaggtacaacgaatttgtgataaaaagaatttttcaaacacgctctagtatagtaaaaatagagtaaaaaaataagctgtctactttttagtaagacaactttcttttaaaaaatatattaaatgccgctgatgggactcgaacccatatggtttcccgtacgattttgagtcgtatgcgtctgccaattccgccacagcggcatatagaaattagtcacagctaatgcaaccaacttctatatattatcatctgattgttatattgtcaagaaaaatttattgattcgtctgtgtagattcgatatctgttttctgactataatattctttcatattattattgtaataagaatcaaatactcttttagcaatcgggacagcatacttacttccagcgccgacgttctcaacaagaacacaaacaactaaatccgggtcttctacattagaatagccaacgaaccaggcatgtgcatatttgccctcattctctgcagttcctgtctttcctgcggcagtatataaatccgtatctaagttataacccgtaccactggtaactacttcccgaagcattttctggagctttttcgcatctttttctgacataagatcggcataaatttcagggatagtttcttttaccgttgttccatctgctccttctacatggtcaacgacatatggcttcatcaaagtgccttcgtttgcaactgcacacataaggagagcgttgtggaacggcgtcatcaacgtatttccctgtccaatgaccgtttgtgggatttcactcttgtctgaattttgggttaattcaaaacgactcttttttactgcaagatcaaaaggaatctcctgattgaacagacattttttatttagtgaaacaaaattctttatgtccaacttactacctaatgtgacaaaagcagtattgcaggattttgcaaatgccctgtctaaatcaacttcaccatgttcctcattttcatagcagctgatacgcacgctattaacaatcgtctgtccgtcacattcataactaaagttcttataagagttcggatgttcttccatgtattctagcgctgtcagtaccttataggtggaacctggcgggtaaagcccctgcgttgctctgtttaagaggcagctttctgaagaatcagaagtaatcttatcccagatatcatctaacttattcggatcaaaatcgggcttggaaactaatgctcttacctttcctgttttgggttcgattgccactaccgctcccctatagtcctctaatgcttcataagcggccttttgcagacgggtatctaacgtcgttattacattatctccgatattcttcttgctggcaacaccgttactgagctgcttcatcagtttttcgtgtgatgtcaaaagatcactgttacaaacagattccagtcctgcctttccataactggtatatccaatgatgtgtgcaaacatattttcgtaaggatagtgccgtatctcatctccagcttcattattctcagaatatgcaagaatcttctggttcgcacttaaaatctgacctcgttttgtctggtcagagagagaagaatttctcttattataagaactttgcgctacgctgctgctatcctttaaggtaaatttcaccacatagccaattaaccccagaaaaagtgcgacaacaataatacttgtctgtagcatataacggttcgtttttaattttttccctcttcttggagtaaataagctctttatatcaaaaaataaggtttccttttgatcgtgcctgcgagattctcttcgttcagtcgtattttttacggtcactctcgtccggctgccctgcttgttcttcttcattctcatcatcctctttataggcaatgataaatatgccctgcataactgcaaaaattattaatgtactggctacagaacttcctccataactgatcagtggaagtgttactccggtagaaggaataaacttagtaacccctccaattgtaagaaacacctgaaaaataaagcaaatagaaaatccatatgctaaaagcttgtaaaagcgacccctcacgtccatcgcaatttttaggaaatgaataaacactcccaaataaattaatatcagacaaattgcaaataaaattccgaattcttcggtaattgcagagaaaataaaatcactttccacaatgggaatatcatttggcctgccctgtgtcagtcctttcccaagccagcttcccgcggcaatcgcaaataaagactgcgtaatctgatatccgctgccctcaatgacagaccaaggatctttccaggcaataaaacgaacccgcacatgcgcaaacagcatgtacgctaactttgccgcaagagtgcccgctccaattcctccaaataaataaattccccttccagtagcgacatagcaaagaaaaacatatacaacaaaatagattaatgctccacctaaatccttttcgccaattaatatgataacatggcatgccgcaaaaatgctcgtaagaagcattgttttaaaattcggtgctttcgtaagcatcgctgcaataaaaaagacaaaagaaatcttaacaaattccgaaggctgcaaagcaatcccatgtcccaaagaaatccagttcgttgctccattctgtgaagtaccaattacaaatacactagacaagaatatcagtccaaggaggccataaatccatttcagctttttgagccagacagccttttccataaaatacggaataaataaaacaatcaatgaagtagccgcagcaataataaattgctttactgctttatcaaatgacaggcgtgttaacataacaaaaccaatcaaaagcaagaaacaggtatgattcatcaaaattcgcgaacagtctacatatactcgtgaatagacaaaaatcagcatcttaaaaaatacgacctgcgcaagatacaaaaaaataatctttgtatccaaagttttggcaaataatacaccataacagataaaatgaaatacaaacataaacaattcctgcctgtccatccgctttacctgtcgtttctcagtagagggaagaaaaacggtaaaacaggtaattgcgtaaataacacccatgatgacaataatataattcgatcctgttgaaatcaaactcaccatactttcattcccacctttctactctattccataattccagtatgaatctgaagtatctttactttgttcttctgtaaaatgctgttctttccatttaagatatctttgttttacggaagatacttctgcttcagtaagttcaaataaatcaaagcgatgtctctttatgtgagaagaaacctctttgatattctctccgatcagactcttcggcttatcctgccaaataagattataacaatccagacagtgtgtagttactaaaagctttcttttctttttatcctcaagccataatcgcccggaagttttattacaatgcccacacgtctttttaaggcactgtgctgactgcattaccggtattcttccataaataagtaattcaaagtcaactgtctgctgctgttctttatccattccctttatcatatctgaaatttcttcttccgacaattcaacaggcagctctcttacggtcatattatcatagagtgcatttgattcctgtatagccgaagaattccaatgataaaaagaagcccctgcaatcactcttgtagtacatccttctaactgcataagaaattccatttcatttatagtatatgcataaattccatcccaaattgacagagaacagatcttttttaatttatcttccagcacattattacctcgaaatacacgaggaagtgcaagatacaggctttttccagcagtcttaatcttttcgcccacattttctaactctttttccgaaaaaaattcccatggaagacagattccatcaaaaaaagtatcctcacaatataaaaatgcctgctttatattatatacacttgcaattcgctcttcctgctctgagtttagttctcgttgtgcctgattcggacaatcatagcgcttattcattagattctgttgattatccaattcttttgaggacaagttcttctcataaaaatattctcttttttctggcagattatctactctatttttgcagatgcgtaatttttcctctaaaagagcaaatccgtcctgacgaattctttttaaagcagacattggaagaaaacatccctcatctaaattcacttcaaaagaagtaagtataaatggtacattaccagtcttgtgcatctgccgcaggatatcttccttcgttaccggcctctttttagaacattcgataaccggtccttcaacaaacacactttcttctctgcaaaaaagctggagcatcaaaggttcgccaacttttagtgtaatatctcctgtcacagggtattttatcacgccatttaaaatatttttttcaatgtgtgtaagaagttcttcattcctcctgcgatatacaggcattccaggcttaatagattgtgtgcgcggagcgttcagtgtcacctgtccttttaaagaagtacccacatctttagaagggactgtaagaatcacttcatcctgcccatcttttgaaacaggaattactaaaatatcttttggatgtaatgtatcttcaaaatgcatccgaactttatttttagagacagatagaactttaccaacttttcttccagtatttttgggagaaacagctgccatcatgtcctgcccattgtgcttgttccaatatccctctgtaaaactgccgcgacagtataattcttctaaggcatgtatatcctcttcttctggttgaaattgtgctctttgttcccagttttcagaaatcttatctaaatatttgcggtaaattgctgtaactcctgccacatactccacatttttcatgcgtccttcaatctttaaagaatccacaggaatttccattaaagacggcagcatagaaagagaacataaatcctttggactaagaagatatttcgtatactttgaaggatttaatatcgttccatcagcattcatcagagtatatggaagtcggcaaggctgggcacagcggccgcgatttccacttcttccgccatacatactgcttaaaagacattgaccagagtagcaataacacaatgccccatgaacgaaaacttccacttcaaggcctgtttctttttttattctttttatttctgccaaagataattctcttgctggaacaactctggtcattcccatgcgcttcgcagcaacagcaccacgaaaatctgtcaccgttagctgtgtgcttccgtgaatttccaagtcagggaaattctctcgaatgaatcgaaccgcaccaatatcctgaacgataacaccgtctaaaccattctcataataaggaaaaagaaagtctcctaattcttcaaaaagctctttctctttcattaatgtgttcactgtaagatataacttacgttcatgaaaatgtgcaaactgcagcgcctctatcatatcctctctggaaaaattatgtgcatacgctctggcaccaaacttttcaccacccatataaatcgcatctgctcccgctgcaacagccgcttttaaatgctcgaaagaacctgccggagcaagtaattccggcaggtttctctttttaatgaaattcattgttcgtctccagtccaataatctgtttttgcagctcattcacctttgctttataatctgcaaccagcttattcgctgcatcaagccgcatatctctatcgacaatctgctgctttaattcataaagctcctgctctctgtcccggccatcctgattaaatacttcaatctcatcccgaagtttaaagagttcttctgtaatattgagcgccagcaaaatatcacgatattctgtggaaagcttattatatcctggctgtttttttaattctcttatcttgccgtcaacataggaggcaagtttttggagatagatatcacttccacccgacaatctatatactttaccgtcaattactactgacaattcacttttttcttccatatcaaccctcctgtgatgcaaaatcttttaataaatctcctccggtaccggatatcccatatgttcataggcgaaagcagttaaagcccggcctctcggtgttcgcttaatgaggcctctctgaataagaaacggctcatacacatcttcaatcgtaccagaatcctctccgattgctgctgctagtgtatctaaacccaccggttttcccataaactttgtaatcatcgcttctaaaaggttgcggtctgtcgcatctaatcccatagaatcaacctcaagtaaattaagtgccgtctgtgccacctcatatgtaatcataccgtcatatcgaacctgtgcaaagtctcttacccgcttaagcaatcgattcgccagtcttggtgtcccacgacttctttttccaacttccattgcaccggcctcatcaatctttactccaagaagttctgctgagcgttctacaattactttcaattcttcatctgtataaaattccagacggtttacaactccaaaacggtctcgaagcggtgcagtaagcattcctgctcttgttgtagctcctaccaatgtaaaatgaggaagctctaaacgtatagacttcgctgaagcgccctttccaatcataatatcaatagaaaaatcctccattgctggataaagaacttcctccacctgccggttcagtcggtgaatctcgtcaataaagagaacatctccatcagaaagtccattcaatactgccgcaatttctcctggtttctcaatcgccggtccggaagtaatcttcaaattactgtccatttcgtttgcgataatccctgctaatgttgtctttccaagacccggagggccatataataatacatggtcaagagactctcctcgcatcttagccgcctcgataaatacccgaaggttcttttttaccttctcctgtcctatatattctgataaattctgtggccggaggctgccttctaccgcaatatcctcctccatcagctctgtgctgatcattctgtccatgttatcaccttataaaaatgttaatactttcttcaatgcttcttttaataactgttctgcatctaacttctctgcttccggcacactatgtacggcacgatatgcttctccattcgaatagcctaatgctactaatgcctgtacagtatccgcaatgctgtctccttctgtaaaggaactctgtggcgctgcttcctctgcccctgaaactgactctaaagcttctagattcagcttgtctttcagctcgatgatcattctcttcgcacctttgggaccgatacccggtgtcttagcgatactcttcgcatcctcactaaaaaccgcataatacaaatcttccactgacatcgtggaaagtaccgataatgcggctttcggtccgatgcctgaaattccaagcagaatctggaaagtctctaactcctgaatcgaagagaatccaaacaatgccaactggtcttctcgtacatacagataggtatgaagcatcgcttcctcaccgctattcacaccctcaagaactcttgacggcacttttatctggtaaccaattccatgattctctatcacaacagaatccttccccttatatgcaactgttcccttaatatatgaaatcaaatgaatttcctgccttcttttaaaattgttactagagcgtgtttgaaaaatattttctgcaagatgtgcatcacgcatttttcaaacacgctctagaacttatattctgacttctgacatgataccataattcccatcatattacaactcttttactttaagcgcatttacccctttctcgaaaatgtgtttgacatataaaacgttctctgctatggttatagcattattatactaagaatttttgagacaacatatgtcattctggaggtatcatgttaacgattaataaaatattcccacaagaaaagattcccgaaaagacagaatcttttttattttttgatatagaaactactggtttttccagagacaacaccatcttatacctgattggctgcggatattttgcagaagaaggattccaattcatccagtggtttaatgatgacggcacaagtgaagaagagattctccttgcctttcaaaatattttagtaaaaaaagactggcagcttgtcacatttaacggcaacagctttgatattccttatttaaagaggcattacgacttaaatgaactaacctgtgatatagaaaaatatccatccctggatttttaccagtttttaaaaccttttcaaaatctttttcagatgacacatggaaaacaaaaagactgggaacagtttcttggcttaaatagagaagacaaatatgatggcggacagcttatcgctgtttacaaagactaccttatgtcaaaggacgaagacttgttacataatcttctgcttcacaatgaagatgatttacttggtatgaagtatcttcttccgctcttttcctatcgtcagattttccttgaggacatcactttacagagaatcgcacccgccaataaagtgtttgaacgtggaaatggcagcattgctatctcctgcagacttcctcgccctctgccacagccattagaggtatctacccctataggagagctcttttctgacaaaaaagatttgtccatactgacgattacccttccttttgttgaggacgtgttaaaacatttttacaaagactatcacaattattattatcttccaaaagaggaacgggcgattcataaaagtgtcggctgctatgttgaacgtcaataccgccgggcagcaaaagcttctacttgctatgtcaaaaaagaaggaatcttcctgccgcttccaaaagcgcagaaacattttggaatacagatagagaattatccttatgaaaagacttttcctttgtataagagagaatataaggaacttagatggtttgcagaatttgatgatgtattctcagaaaaaaatacggggatttctgtatatttgcgggatatcataaaagaactgctgattactcgtatggaatgtgatttataggataagtaattctgctacagccaaagacagaaccaggaaaaagaaaaaatccctatttgtgacctcgaagcaaaaattggatgcaagcgtttccgcgaacattcaacctgccgcgactaaagtcacaaatagggattttttatctttcttatttcgtcagctttgcctaaaacgactatttcatctcttttgcaagagccacaatctgcgcttcacttgtttcatctaccgcagagcgaattgtcaccgttgtatctgcaaatgtaatattcttgctcttctcaaaagcagccttcataatctttgctgccagcggggtccagcttccgttctctacaaatccaatcgtacggttctgatagcttctctctgtcagatggttaatgaattctttcataaatgggaaaatatctccgttatatgtcgttgtggcaagaattaactttccgtaacggaatgcatcttctacagcttctgccatatcatctctagcaagatctgtaacaacaacttttggacagccttcttcttttaacttctcagctaacagttctacagccttttttgtattgccataaacagaagtataggcaattactgttccctctgtctccacctgataggaagaccagatgttgtataggttcagataatgctctaagttctcagttaatactggtccatgtaatgggcagattgccttaatttcaagggagccaaccttgccgaataacttctgtaccattgggccatatttgccaacgataccgatgtaataacggcgtgcttcacaatcccactcttcctctacatctaatgcaccaaacttaccaaaagcatctgcagagaagaaaatcttatctgttgtatcataagtcatcataacttctggccagtgaaccataggagccataacaaaagtaaggttatgcttacctgtacttaaagtctctccctcttttacgataacctgacggtctgcaaaatctgttccaaagaactgcttcatcatagggaaagtctttgcattaccaacaatctttgcttctggatacttttcagcaaagttagcaatattagccgcatggtctggttccatatgctgcacgattaagtaatccggagttcttcccgcaaaagcctcctccagatttgcaagccactcatccttaaaatgtgcatctaccgtatcaaatactgcaaccttctcatcaagaacaacatacgaattatatgccattccgttcggtacatcatactgaccctcaaataaatctacttcatgatcattcacaccaacataaataatatcttctgtaactttaaacatgtaatcacctcatatttctgattattgtaaaaaaatatcactacgtaaccaccacaattttctatgtggcacagttcctattatataaaatttaatagaagtatacaagacaaatttcacctaatttgcaaactggctgttatacagcttcgcatagaatccattctgctttaacaacgtctcgtgatttccctgctcgataatatgcccgtctcgcatgaccagaatcacatccgcattctgaatcgtagataaacgatgtgctacgataaagcttgttcgtccagccatcattttcgcaaacgcattctgaatcttttgttcggtacgggtatcaatggaggaagttgcctcatcaagaatcagcatagacggaaggtcaagcattactcttgtgatacaaagaagctgtttctgcccctgactcattcctgctccatcttctgtaatatatgtgtcgagtccctttggcatttttttaataaagctgtaggaatgagcctcttttgccgcagcgataatctgttcgtcactaaagccttctcgtcccatcgttatattatcacggattgttccacttcgaagccaggtatcctgtaataccataccgtaggaagttctaaggctctctctcgtaatatcacggatatccgttccctctaccatgatcgttcctttatttacatcataaaaacgcatcaaaagattaataattgttgtctttccgcacccggtaggtccgacaatcgcaatacgctgtccttttttcacattaagattaaagtcttcaatcaggcgtttctctgtggtataggagaagtttacatgagaaagttcgatatttccctctggatttgctagaacaagggcatctttcttatcatcggtttccggtgtttcctcaatgagttcaaaaatacgagccgcacaggctaatgcgttctgcaattccgtaactacaccagatatctcattaaatggctttgtatactgatttgcatagcttaacagacaggtaagctgtccaacgctaagtcccccgccaatggcagtgagtgcaccgcttaatgccacgcttgcatatacaaggctgttgacaaaacgggtagacggattcgtaatagaagaaaagaagatagcttttaaagaatatccctgtaacttatcattcacagctgcaaaacgttctccggctctcttttcatagccaaatgcttttacaaccttttctccttcaatcatttcctcaattaatgctgtctgctctcctcttgtctctgactgcaatttaaacatagagtaagtgtgagttgcgataaaacgggcaactaataaagaaatcggtgtcagacagacaaccaaaagagcaattcctacatggatggaaaaaataaatccaagcgtaccgagaatcgtcacaactccagtaaaaaactgggtaaatcccattaaaagcccatcggcaaactgatcaacgtcggcaataacacgacttactacatctccataagagtgtccatcaatatatttaagtggcagcttttcaatctttttcattgcctcattacggatgtctcttgttacatgaaatgtaatgtggttgttacagatattcatgatccactgtgtgattcccgtaaataaaataactgtcgcacctttttctaatatttttgcaatcgccgcaaaatttacctgtccttttttaataataaaatcaatcgcatctccgacaaggattggtacatataatgtaccggcaacggtaagtgccgccataagaatcgataaaatcagaaggaaacggtagttttttaaataatgccacactttttttattgtgctttttcttttgccgtttgtattttgctgtgccatttacgcttcctccttcttaaactgtgtctcataaatttcacggtaaatattacaggacttaagtaactgttcatgcgttccctgccctgctatctttccatcatcaagcactaaaatcatgtcagcattctggatggaggaagttctctgtgacacgataaatacagtcggttttctcttcatatcctgaattgcttttcgaagcctggcatctgttgcataatcaagggcagatgcactgtcatccataatgaggatatctgactgtggcactaacgctcttgctaaagtaaggcgctgtctctgtccaccagaaaggtttttaccgccctgttctatcttcgcatcaagtcttccttcttttgtgtcaacaaattcctttgcctgcgagatagcaagtgcctcttctatctgttcttctgtcgcatccgggcagccaaaagtcaaattatcccgaatcgttccggcaaaaagctgcgccttttgtggaacaacagaaattgtgtttcttaaagatccataagtataatcctgtacatttttccctgcaatatctacctctccctcgctcacgtcataaaatcttggaatcagattgacaagtgtagactttccagaaccagtacctccaataattccaatggtctgtcctggcattgccttaaaggaaatattctccacagcatgatctccgcctccggcgtaagtaaaggaaacgtttttaaattctaccgctggagtggtattgcctgcagcagcaactgtttttgttccttctttcatagatggctcaatatgaaaaacatcctgaatacgattaaaacatgccatcgcttttgtcacggaaataatgaggtttgccagcttgataagctctacaagaatctgggacatatagttataaagagcaacaacctgtccctgtgataacgtaccaagacttacacgaaccgcaccggtatgaatcaataccaaaatagcaaagttgataataataaaagtcagtggattcgtaagtcctgatatttttccagcaaatttctgtaaagaagtaagttcttcattctctgctaaaaacttattatattctgcctgttcctgatgaaaagcacgaatcacacgcacacctgtaagattctctcttgttgttccaagaatcgtatcgagtcctgactgtacctttttataaagtggctttgtaataaacatgacaccaaatacaacgatagacaataaaatgattgccacaacaaaaatcatcgcagccttcacatcaatcgtaaatgccatgatcatcgcaccaaatacgataaatggagaccgcaggaacagacgaagtaccagattgattccgttctgcacctgattaatatcacttgtcatacgagtaatcaatgtggatgttcctaccgtatccatctcctcatagcctaatgtctgaatatgggtaaataattcataacgaatccctgttgccgctccaacagcagactttgccgcaaaatactgtgcggtaatagaacatgtcaatcccactgctgctaataccagaagaagcagacacattcttatgatatgcccagaatcttttggaacaataccatcgtcaatgattgacgcaacaaccaatggtacaaataattcaaagaacgcttctaacatcttaaataaaggagccagaacactttcttttttgtagtctttcataaagtataataatttcttcataaaatctttctttttcatcctttctcttcaaaatttaatgactatatcaatcccatgtacaaaatcgtatctataataaatattctcctttgtattcatggttatctgccataaatctcccgttacagtgtagcattttactctttctttttaaaggattaattttaaaggattaattttaaaggattaattttaaaggattaataatgataaaactttttaatacctttgtttgaaaaattgtcgctaatatgttatactaataacaataagtgaatttatacgtttattgaggtgattattttgaaggaaaaaaacaacgaatctgctgaaaactatttagagactattttagttctcagtaaaagacttcctgttgttcgttccgttgatgtcgctaatcagcttgatttcaaaaaatcaagtgtaagtatcgctatgaagaatcttcgcgagaagaatcatatcactgtaacagatgccggatatatttatcttacagaatctggaaaggcaattgcggatatgatttatgagcgtcatcaattacttacatcatgtttagaaaaattaggtgtttctgccgaaattgcagagaaagatgcctgtaagatagaacatgttatcagtaaggaaagctttgaggcaatcaaagagtatgtgaaggcgaacattaggtaaatgctgaatgaatgtcagtgactgccgaacccagagagaaggaataataaaaagctattgcagtgtttatagtgaacactgcaatagcttttttattatttataatatttttgtcatatccattaaggaacagtaatattgtctccagtcttctttttcctgcatatagaatactttaatgtatacggtgagtttatcggtttctgttcttaagagatggagcataccatctgcaccggatactggattcaggaaagagttttcgagcatttcgttgaactggctgcgttcttctgctggaatccgcgctaaaaattctttttgaatgtcttctttgaagtgttctgctccaatcatctggaagtactgttcattgacgcgggttacctttatcttgccactctgtacttcaaaaaaaacaactgggccaagtacattattgagcatactgtcactgacaaaatttgaatcaatgaactctcggatatgcatcggctctacctgtttgtaaacaattccctgtgtatcaattcttctatggtcgctcaaaagttcttcaaatttaggaattggaaggggtttataataataaaatccctgtgtatagcgatagccaagaccttgtacaaacttctcctgactctcatcttctactccttcaacaacaatcgggagatgtaacatacttgccatatttacgatggcttctaatatatgtgcactttttttgcgttccgcctcctcaaaacgaaggaaacgcatatcgagttttaatacatcaacaggtatattctctaacatatttaaagaagagtatccacagccaaagtcatccatcataacaactaatcctccgcttcgcaatgtatttactgcactggcaatccggttattattctctgtgtaggcactttctgtaatttctactttaatcaaatgtttcggaatctgatatttctccatcaaatcaaataaataagccgggacattcatcgaaaaaatgtcgatgcgggatacattaatagagattggaaccggagaatgtcctgtgtcaatccaatgtctgagccactgacagaccttttcccagatataacggtccagacggtctatcatcttatttttctctaatactggaataaattcacctggtaaaaggaactctccatcctctttctgccagcggaccaatgcttcggcaccgacaatctgtcctgtcataatattacactgcggctggacaaaaaatgtaaattcttcgttttccaagcccttctctatctctgctaacagatagacttcctcttctaaacaggattccatctctaaagtataacgacagatatgccatttataatcttcttctgcatgagagcgcgccagcatggcacgatcatacattaattctggctgtatcgaggtatcttctatcgtgtatacaccaaataatggaaagaatacagatgtgttattccacttgccaagcttttctataattttttcccgtatgctacaaagtaattcatcactgtctggcaaaagagcaacaaaattatctccgcctaaataggcatcaattccatcattctccatggtactctgtttcaaacaggcacaaatatagcggataacctcgtctccggaacttcttccatacaacttattaaagaggcgaaaatgttcaatatcaattgccgctatacaatatgtattcggaagaagctttggtagtttcttccgaagtccatccataaaagaatggttataataataatcgcttaaacttttactattcataatccctcattatcggtcctgtagtttttttacaatagttctgctaactagtcgttgctgtttcatcactgtatttcgttataatatcataacgcatactagttctactataattttcttatattttgcaatatctcttactgaaaaattcactttttttattctaacatactttctgcaaatattccatagcccatttgcggattatcaattaaaacatgggtgactgcaccaacaagtttaccattttgtaaaatagggctgccgctaagtccctgaataattccgccagtaagagtaatcagttcggaatctgtcaccctgatttttaacgtttttaaagaatttttttcgtgaaagaatactttttctatttcgatggaataatctttgctttttccactgatactgcttctaagatatgctttgcctgttttcacttctgatttttttgcaatacttatttttttacctgtaaaaaattcttttttgttttctgttatttttcccaaaattcctccgttcgtattcgcatatatctctccaagataattttgcgggctataatcaatcgtgccgattatttctccaggcattcctgattttcccttcaaaatcgaagatatattagttcgatacgcacttccaccctcaattaaaaagcggacaccaatatctccgtcattaattccatgcccaagagctgcaaaagtcccatcctctcttataaaagtaatcgtaccaattccctgcgtatcatttcgaatccacacaccaatttgataacatttattttttgcagaatatacgggttgtactttcacctttatctttttgttcttacgctttagtgtcaacaccacttctttttctccatttttctgcaataagcgtataaattgctgctttgttgtgatattctgagcgtttagtttcagaatataatccccttcctttattttacaggatgccggagaatttttcccgtcaatctgctggagtcctaatacaagaattccttccgtttttatataaattccgattggtatccctgatgcatacactttttcctcgcttttttgttcggttagtcgtttccccgtctgagattttgccgaaacggtttctttttgtgtagaaaacacagcttctgtctgtaaaacgtgtccatattgccccatgatagttagtataaatactaacaatacaatgtaaaactgttttaatttttccctcataaaaaatgcccccatatctaaattttcacttagtatggcaggcatcttcctgtttcaaacaggcatattttactgttttgccaaaacacgcatttctcttgcattttgtaaaacggcttctgtaattttcactccgcctaacattcgtgcaagttcttttaccgattcttcttctgataatgggtaaatattactgattgtcgaattggcatcacttgttttttcgattaaataatgcgaatctgccattgcagcaatctgcggcagatgtgtgatggcaataacttgtcttttttttgcaatataagcaagtcgttctgaaactttctgtgccgttcttccactgattcctgtatctatctcatcaaaaatcaatgtctcaatattttcttcatctgctaaaatagacttgattgccagcatgattctggacaactcaccaccagatgcaatctcatgaagcggtcgtactgcctgtcctgggtttgtagaaatcataaagcagacattatcctttcctaatgcagaatagtgttctgactgttcaaaagcgatttcaaagacaacatctaaaaagttaagatctaacaatgcttctttaattaattttgttaacggaatcgctgcctctttacgcaaagcagtcaatctctcacactgtatatccagtttttcctttactttagataattccctttttatttcagaaatatactcctcataattggaaagtttttcatatttttcaacactgttatcatgatatttctgtattttctctatagaatctccatactttgctttcaaatgattaatcagattcaagcgttcctctatttctgcaaattgctctccatcaaattccatggaatcaatataactggaaagttctctgttaaaatcattcagcaaagaatcaatggtctgcaactgctctgttagtcccctagcctcggcatcaagattagacaccgtataaagccgttgtacggccgaaccaatgagatcacccgcacaaccgttttgccctgctgtcacttcatgaacagccgcacagtcagaaagaatttcttttgcatgggatactttctggtactccgtttcaagagattcatcttctccagggcgaagttgcgcttcctcaatttcctggatttcatattttaaaaattccatctcccgaattctttgttcctctcccatattttgttcggaaagtttcttttgaagttcctgatactcatgatataaggaagcggtcttttcttttacaggagcgattacacttcgatgataactatcaataattttcaaatgattctgcggttttaaaagaagctggttctcatgctgtccacttaggtcaagaagaagcggcgaaagttcttttaatctgccaattgtaacactgatatcatttaccttattaataactctgttattggtaatcctccttgatataataatctctccatcttcaaatggaatctcaaattcttccatctttttttggactgcctggctttttgtgtgaaatatcagttcaataagtgcactgtcacagccatgtcttatcatatcttttggtattttcgcaccaagcgcagattgaatcgacccaatgagaatcgacttacctgcacctgtttctcctgtaagtatattgagatgatccgtaaaatctacctctgtttcctcaataagtgccagatttttaacgtgtaaatttatgagcatagcaccctccgatgttaacgatgtcccttcataatcgtgtcaatttccttcataacttcctccaccataggggtttctttcaccacgcacataatcgtgtcgtccccggcaatacagccaagtactccatgaagagaaatagaatcaatcgccgcggcacatgccattgccatgcctggaactgttttgattactaatatattttctgcattatccatgtgaagaattccctcagacaatactcttttatacttgctggaaacatgaatatcctcagtctgaatcggtgcatacttctgttttccatttgcaccggtaacttttgtgagttttaattcacgaatatcccttgaaatcgtcccctgcgtcgaagaaaatcctgcctctgacaattttttggtcagttcttcctgtgtttctatatcatttgtccgaataatctccagtattttttcctgtcgttttcccttcattcttatctccacttctttttataaaagcttctcctttaaaatctgcacaaagctgacttccgttgctttaataaacggtgttacttcctgtgatttatatatctttacctgatctcccggaacaatgcttaacccttctcttccatcaaaggaaataatagcctcttccttaatattacttcttatctgttctacttccaccgtaaccacatcttccttggcaagtacaatacttctcgcagtaagagaatgtgggcagattggggtaatcacaaagttcttacaagttggattaataatcgggccgccagcagacaagttatagccggtagaaccagttggtgtacaaacaataacaccatctgcccggtagcagtcaattgttgagccattaatacccacttttaaaccgataactctcgaagctccacaacggttaatattaaagtcgttgagagcgatatatgttgccgctttttccccctgcttatacacttctgctgtaagcatgatacgattctctacctgatattggtcttttaataataaatccaatgtctttgatagatcagcaagattcacgtcggcaagaaagccaagtgttccaagattaattccaagtaacggaatcgtatttccaacaagcattcttgcagcagccaaaatggtaccatctccaccaataacaagaatacattgtgtcccctctggaatatctatagaagtaacgtttctgttatactggtcatatacgttacatactgcacccattcttgtaatatgatgtttgatctgttctgtaatttcaagattaatatctttttgcttatttgcaataattaaaaaattattcatgctgtctatttcgccgcttcacgatgagacaacgactgatgggatgccgcaacaacatccggtatcatctcatcactaatctggctttcctccggtctgtttaataaatgcagtaagtactctatatttccctctggtcctttaatcggtgaataatcaagatgcagcagtgaaaaaccaagtgttaaggcaaagtccataatctgctttataacatcttcatgtacttgtcggtctcttactacaccttttttccctaccttttctcttcctgcttcaaactgtggtttaataagacagacaacctgtccatcctcttttaaacacgcctttactggtggaagaatctttgtaagagaaataaaggagacatcaatagaaataaagtcggccagttctccaatatcttccggtttcacataacgcatatttgtcttttccatacaaacaacacgttcatcattcctgagtttccaatcaagctgtcctcttccaacgtcaacagaaaatacttttacagctccattctgaagcatacagtctgtaaatcctccagtagaagccccaacatccatacaggttttatcttttaaggaaaagccgaactgttctacagctttctccagttttaagccaccacgacttacatagcgaagcgtagaaccgtgaatctcaatggttgcggcagccttctcatcaaaggtgcttccggccttatcttctcgctggccgtttacgaaaacgactcctgacatgatcatcgcttttgctttctctctcgacgcagcatgtccctgctctactaacaatacatccaaacgttgtttcattctaattcatcctatctattatcgactttacaatggaatccgcattgattccggcttcttctctttgctcattcacagtggcatgacccacaaaataatcggaaatacccagagtaagaagctgattcttgcatacatttttatggagaaaagcagaaaccatctgcccatatcctccgattaactgattctcttctacagtaacaataagtgaatattttttggacagtacatgcagcatctcttcatccattgggcgaataaaacgaacatttacaagccccggattatatccctgacttttaagaagctgcactgctttttcacattcttccataatatttcctactgccaggattacgacatcttgtccctcgtaaatcatttcactctttccaagttctatcggagcattatattcagataaaccatcatatacactacctcttggatacttcatagcggttggtccattatactctaaggcaaacttcatcattgctggcatttctttttcattctttggagccatcaataccatatttggaatatgactcaaataagaaatatcaaaaattccctgatgtgtctctccatctgcgcctacaagaccggaacggtcaatgccaaaaaatacaggaagcttctggatacatacatcatgaaggacctgatcatatcctctttgcagaaaagaagaatataccgcaaaaaccggacgcattccctgcgcagcaagcccggccgcaaaagtaacagcatgttcttctgcaataccaacatcaaaaaagcgctttggataatgctttttaaaagcttttaaacctgtgccagatggcatagccgctgtgattgccacgatctttttattctccctggctaattccaccaggctctcagcaaatatatctgtgtaggtctttttcgttttctttgctaaaacctctccggtctctttatcaaatggcccgattccatgaaacttctctggattcttctcggcatacttatatcccattccctttcgggtaatcgcatgaatcaaaatagggccttcgtgctgtttcgctctattgattgcgtgaatcagttcataaatatcatggccgtttacaagtccataatacgtaatccccatattttcaaatagcattcctggaataaaaagctgcttgatggaatcttttgatttctttaatgttctcgcaacactttttcctacaccgggaatattatttagtgcattttctacattctccttaaactcactgtaacttcttctagaacgcaaatcgtttaaataacggctcattcccccaacattctctgaaatcgacattttattatcatttaagataataatcatgttcttcttttctcttcgaagaattgataaattattcagggcttcgtaggccattccaccagataaagcgccatctccgattaccgcagcaatggtttcttctttttgttctaaatctcttgctacagccagccctaatgctgctgaaatagaggtagaactgtgtcctgtgccaaatacatcacagtcactctcacatcgcttagggaaaccgcaaagaccatctttttgtcttaaagaagtaaattcgtcttttcttcctgtcagtaacttatgaacataggattgatgccccacatcgtataccaccttatcctctggaaaatgaagacagatatgcagagccattgtaatttccactgctcccaaattcgaggcaagatgcccgccagtctgactgacatgatctatgaggaaatctctgatttcctgtgccagaatcggataaagctttggagaaattctctttatatcatttggttcttttattttatttaataaacgtcccattacgcatcctccgaatggtatttttaattttttcttccaaccagatatagaagtaattcacgtaaaaaagaatttttatactctaattcatcaaaaatctgtaacgcttctcttgtatattgttctgcatcctttttagattgctctatacctttgaataagacgtatgtattttttccgttcttttcatcgcttcctgctggttttccaatttcttcactggtacttactacatcgagaatatcatcttctatctgaaaagcaatacctaccttgttggcaatctgttcgatcatggatacttctttctcggaagctcctgcaagtactgctccgatcatcatcgcacattcaatcagcgcagctgtcttattattatggatatacattaatgtatcaaaactgattgccttattctcctgttctacatcgacagtctgtccgccaatcataccataaattcctggttttcttgtaagaatctgcaatgcctttgctgtctgtatatctttgtttgttccgtcaaaagcttttgctgctgtctcaaatgcatagtttaacagagcatctccggctaatatcgccattgcctccccaaactttatatgtgcagtaggcattcctcttcgcaatgcatcattatcaagtgctggaagatcatcatgtatcaacgagtacgtatgaatcatttctatggcagccataaaaggctcgattacagaagaatccgctcccccaaacatctcatatgtctctgccataagcattgggcgcagacgcttgcccccagcttttacactataattcattgcagaaagtactgttttttgtaatcctttttcttctggaagatagaaatcaattgtttgttcaatcttctcaatcttcttcgaaagctgttcctttatggatggcatcattttgtccctcctgtaagataattatctctttttgtgttttatctaatgtctgagagcatttatctaaaatcttcactccctttttatataagtccatagaatcagacaggctgatttcttcggaagaaagctgttcgataatgtcttctaactgctcgaaagctccttcaattgaaaattttgtttttgccatgacaaacctctttattttttattctttttcactgaaaccggcattacctcagcctgtccatctgaaaaagtaatgaaaaaaggattctccttttctatctgcccggcagaagtaaggggatttccctctttcgtttgtgcaaatacatatccgcctctcagacgggatgttggggacagggcggaaagcctgtctacatatcttgtaaattgctgctgtctgctttgatacttatcccgcattgcctgttgcaatctgccttctaaccgctcgtaaatgagctgatgactcatcagctttttatctggccgctgtgcctcaagctgcctttctaacaaagcggtcttcccatacatcagcatcagtttttgctgtagcagtgtcccgagtacttcctgatagttatgcattcttgtgtaaaaagaagtcatatccggaatagccagttcacaggctgcagaaggagttgctgcccgcacatctgcacagtagtcagcaattgtcatatcaatttcatgtccagttcctgatatgatcggtgtgtctgcataataaatcgcatcggcaacttctatctcattaaaggcccataaatcttcgatagagcctccaccacggccgataataataatatcaacccctgctgtatcaaaataccgaatacctcttgcaatctgagcagccgcaccctctccctgtacttttgacggatagaggtacagctgaaccgaaggatttcgtcttttggcaatacttttaatatcttctattgctgccccggtaagtgctgtcacaatcccaattttttctggataaggcggcaacggcttctttctttcaaaatcaaaatatcctttctgcgctaattcctgctttaactgttcataacgaatatataattctccagctccggagagttctatctttcgaacatacatctgatatgttcctgtctgttcatatacagaaatattaccacaagcttctataagctgaccatcttcgagatgaaacgttagccctttatagcggtccgaagaaaacataacacagcgcagtgcactcttttcatcctttagtgtaaaataaatatggccggaagaatgatatttgcagttagaaacttctccctttaaatatattttttttaaggcataatcgctttcaaaaatacgatgaatataagaattaatttgtgtgacagaaaaaatatgcttcatttataaatacccaatcaaaaaggcggcaaagaatattgttccgtgccgcctcattcttcttcagttatccaggtacaggtcacgaattattcgctatgccagctttgcaagaactccatttacaaaacgaggagcttcctcgctgcaataaatctttgcaagctctacggcttcattaatggcaactcccgtaggaatattcgcatcatttgtaatctcataaactgcaagacgcaaaatggcaagctctggctttccaagtctttcaagtctccagccctcacaaatcgaatgaatctgctcatcaatctccggaaggcgttttaagatacttccaatctttgtctcgatatagatctggtcttttccctctatatccggtctttcttcaaagtaccattttatctgctcctgtaattcttcctgtgtattaaattctacgcgaaacagtaaaagaaaaatagtctctcttacttttcttctagacatcttcatatgtcaaacctccgttatcttccgtgtactctttgtagtcagtctattcataatccatctggattccggctatgcggatattcacttcagaaaccgtaaggcctgtcatcgtctcaatcgcgctctttaccttgtcctgtacttcctgagaagtttttgggatgcttacaccgtagctgagtacaagattcagtatcacatcaacttgtgtgccagtaattgttacttttacacctttggaaagcttcttcattccaagcttacttacgatttcattggtaatattaccggacatcttagcaacgccctctacttctgttgctgcaagaccagcgataactgcaactacttcatctgcaatctgaacctgtcctacgtcttctatgttataaaccgtatgatttatctttgtatctttttcttttcccatggaaacctccttttgtctacagtccacagaaaactctccatgaaatttcccacatcattaacagatattggaaaactacatggaaagtcctcacataaaaatgtaaacaattttatatcgatttattctataattataacagacatctatgtttttgcaacagaaatcttttaactttctgtcgtctgcattttacttatgacaagctgactgacactatatcctgtttttcttgtaacaatatcctcaatctgtgcccggtcagacgaggaaagttcctcataatttagtacgacatctacactgtcctctccgatagagactactgcatcttcaaatcctttggatgccaaaagctgttccgttgcagattctttttccataatatccgcaagttcagtaagtttatctaccgcttctttctttgcatcttcactgacagaagtgctgttaataatttcattaagggactctttggttttggaatgtgtctgttctctctccattctggcacccgctacatattcacttacctgcgcctgtgtcaggacagcatccccaatggtctcactgcttacgtctgtctgcgtctcttttgcattctctgatgaattttttgaaagactttttgatacatcttttgaagccttagctttttcctttatcagggaatctccatctgaaatatccatcgtatcaattgtttccacggaaccggctgtttttttcgttccatcagaggatgtattttgctctgtgaaattcagatatcctgcaactgcaatcatgattgccaatgccgtaatggcaatctgatttttctgaaatactttcttcattttgcaacctccatttttaacactttaatatgatttgccgaaactccaaacaatacctgcactgcttctaaaacggatgcttctaccaccttatttcccgctccttcacaggaaatgacaattcctgaaatttccggctctaattcttttattacataaggggcagaatttccagaagaatcggaaagaatcgtctcttcctgctttttttgatttttatttactttttgtgtttctacgcttctttcttcctctgtttgtttctcctctgacaaatctttatttaatacagattctttagaagattttaaggtaatcatcacttctgcttttcctacaccatccacattttcaaggatatgtactaatttattttcaagtgcctccacatatgcatcattctgacttgtctctatggatttttcttgtttttcgcttgtttttgaagaagaatttttccattcagaaaaattagcaacaagaagaacgattcccgcaattgctattaaaataattttctccatcccaaagtcttttaaacttatctttttaggcatttttttatccatcttcactccacctctacaaaaacatctgattcttctaaatcataaagctgcattaaaatcttttttaaactttctacatgtgagggattgtctgttgtatgaagcgtgctgtcgctcccttttagcaagattccccttatctctatctgttttaaatgttcttttttgttatcccaccaaaaggtaatcttttttacctgaatattctttttctttgcaatttcttctatctgatttttatatgctgtctcatattctttttttagcacgtcttgcatatcctgaaattcttttacatttcctagtagatttcgttcattcttccattcttcctgcaaaaaagatacctggaaatactgctctgttcctgcaaaatcaatgacaggttttaacagacacactacaagcaaaaatccagaaaaaaaacgataatatttttcatatgctgttttttgcattaaattatcacagattaataatagaacattcatatataaaattgtttttaaccagctttttatatattccattacatccagctcctacttttatttatggtcttttatattttcacaatgctttatcctatatgatttgtggtaagtgtggtaagtgcgataatcacaataaataaaacagaagacatacacaatacctttattaacagcaatccacatttcactgccgcactaatacactctacaaaacgttcatccgcaatcggctctaacacaacagacaataggaaataaaaaaagacataacataacagttttgtaagaggcaaaagaagaaagagaaaaaggaatacaatgccagctgcccctaatgcattttttataacaagggaagaaccaagtaccgtccctgtaacactttggacaacagatcctgctcccggaatcaatccgatcattttgtttagtacattattttttgccgcatcaaaagaaggcgcaatcattgtttctaacagatgaaatccaaaaaagagaaaaaaaagtacctgtacaccttttgataaaaaaagaaaaaggccttcacataatcttgaaatattttgcttttttgaaaatcggtttagtaactctaatagaagataatattgtagcaacggaagaaaaatttttatacaaatccagtttaaaagcagcactacaataataaaatactcataaaatacaacacctgtagatagatttccagaaagagaaactgccagtgtatacacaggaagcagtacttttagaaaagaggacagaagaattactgtattttcaaacaaggttgtcattgccgtaaaattagtaaaaataatagaaaatgttatgagatatgtaacaaaaaatccactgtccgatactccatatggttgaaaggaagaagagatattcgaaaataccgccgaaaataagatgacaccgataagctctgtaataagtattttcgaagaaaaaacttctctaaaagcaatatctataaaccatcctccgatttgctgaaagacttctgtaaactgcatagaaagaattttttcaaagatagaagaaaaatcagggtacttttcttctccaagttgttctatttgttttgagagagctgtaatatctatttcttctttttttgtctgtgcctggagagtaagtggatgaagatagcaaagaaaaagaaagtgtgtaagaaatcctataacatataaaaaagttttctttttattttttcccattttttacctactttccgttctggccttcttttctataaaaaatcatcatgtaagtaaatgttcgatcgtttcaagtaaggaactgataattggaatacttaatactaaaatagataatttaccgatggtttctatctgaaaagagatggagtgatagccaagatcctcacacaaattagacgcaatctggcatatataagcaatagcaagtaattttaatagtattttaatatacatactacttatcggaattctcttttgcaatgtctgtacaaaatttaaaacttctttcaaattagaagtcagatatccaatcaggaataaacagactgccaaaagaacaagtgtactatattctggtttaaattgttttgtaaccattgcaagcattgctcctgcaattcctatcagtgcaattttaaaaacaagcatcctatcctctcctataattgaaaaaggctgtatatctctgtaaaaagttcactgatgcagggaataatccaggaaagcacaataaaaagacctgccagagaaacaagaaatgcctgttcttcccgtcctgaatgttttagtacctggccaagtattgtgacaagaattcctaccgctgcaattttaaaaattaattcaattgtcatctttctctcctttttcacgctacctgtttcttttaaaaaagcaaaattactgccaatgcccccatacaaagacatgaaatgaggactactttcttcttatttgtatattcttttttcatctgcaaaattttctcatttaaatatgtggaaagctgctttatctcttccctctgatactccatatcatcggacaaaagatttcttccagcatttaagaataaattttgttcttcttttgaaaacttttctttccatgttttttttaaaagtctttcatagattgtcaaaaagctttcctctgtattttttgttaatgtgatagaaagctcaaaaaaaaattatgccagcgggtattagtacggtcgcttaactctccaaataaaataggcagcggcgttcttgtattacgtatttccgattcaagaatccgatataataaatccccttcttctaagaggcggatatgttctgcagcaggctccatcaatttcattccaaaaagataggctgcaattagtaccagactacctcccaatatttttaccataaaattttttctcccttttctttgattttttatttttcttactttctctgctgctcttttacttttataagtatagattatctgttttttgttatttatttctgtatcccatcctgattatatatcgttattattcgttctctatcttccttcttacttaaaaatacatatcgttcaaaaggatatttttttaaatattcccccaataccgggcgtgcaaaaatatcctgcatcgaatttccatgtactgtcattaataaacgacagccacaatttcgtacatatgccattgccttaatatctttttctccgccaatttcatccgcggcaagaatttccggtgtcatagtacggagcatcattagcattcccgccgcttttggacagtgatccattaaatctgttcggtttcccaaataaaatccaattccttctcgggtgcggtttccaatctcactccgctcgtctacaacagctacattctttcctgtaattgtgtctgttccatcagaaagcaggcggattatgtcccgcaaatacgttgtttttccacagcctggcggtgagattagaagtgtgtgacaaaatgtgtttccttcaaaaagttttggtacaatgcactctgcgcatccaatgacttctcttgctacacgaagattgattgaagaaatatgttttatctgcggcttttcttccccctgtaataatatttgccacataagcctgcccggtgtcctccttttaaagtaataaatccttccccgatttcttctgtgtaagcaaaaacagaatactggctgattttttcaaagataagttttagttgttccggcgataaaatccaattatcctcttcttttgctatagctcttcttttttccgcagcttcttctttttttaaaaaatagttttcctgcgttgtctcaatcaaaaccggaagatctgctcgcagacggatttctgttagatttttaaaagttacgctttcttctattcgctgccttaatttttgtggaaaaatctgaagcagttcctctcggtatagcttctgctgcacctatttcctcctttctaaaacggctatataaaaattcaagaatgccccggcatacatgctccttcccctttttgaaattgatcatatagcaggtttttataaaacaaaaatcttaatgaagtatccagcaatggaattaacgaggattctcgcttaattccctgagaattttgttatctgtaatacaatttccttacacaaaaaaaacagcctgtttcttataatatatgaaacaggctgtaagatatgttatcttttctttttataatttaattatgaatttagttgtacaataaggaaactcttcctgctatacaatgattcctttataccacaggcgatatttagatcgcattttacaactacagagtctattgataaacacctcttgttgttctttcctttggtttgaaaccagcagcacgtaaggcatctatgattttcttcttatgattatgtccaaatgcttccattgtgatcgtaagctctacagaactgttacggtttacgctgacaaactgattgtgctcaagcttgataacattaccctgtacatctgcgataactttagatactttattaagctgtcctggtacatccggcagtaaaaccgacacggtaaagattctggaacgctggataagaccgttttgtacaacagaagctaatgtgatgatatccatatttccaccgcttaagatagaaacaactttctttccttctggttttaaatgttttaaagcagctactgtaagaagtccggagttttcaacaagcattttatggttctctaaaatatcaaggaacgcaacgattaactcgtcatcttcgatggtgataatatcatctaaattctcctggagatatgggaaaatagtttcgcctggtgtctttacagcagtaccgtctgcgattgtattgactccctttaatgttactggatgtcctgcttttaaagattcctgaaggcagtttgctccggctggctctacaccgatgactttaatctttggatttaacatcttagcaagagttgaaacaccagtagaaagtccaccaccgccaactggtactaaaatcatatctacggtaggaagttcttttacaatttccattgcaatagaaccctgaccagttgctacttctaaatcatcgaatggatgaacaaaagtatatccatgttctgctgctaactcttttgctttttcgcaggcttcatcgtatacgttaccatgaagaacaacttctgctccaagttcctttgtacggtttacctttaataaaggtgttgttgtaggcataacaacgattgccggtgcaccaaactttcttgcggcatatgctacaccctgtgcatggtttccagcagaagctgtgataagaccttttgctttttcttcatcacttaatgtactgattttataatatgctccacgaatcttgtatgctcctgtgagctgaagattctctggtttaaaataaactttgtttcctgtcatctgtgagaagaagtcactttgtacaaggtttgttggcagaacaacttcctgcactcgctcgtacgcttcttcgaacttgtctaatgataatttttccatcattatatgcattcctccattatattcttcttgcatttttataattatatcgcaattatataattatgaatagtttttttcattcttttttcctgtctgcagttgtttgaaattataattattgtcaatatacaaaaaatttattattgttaatttttatatattaacaattttttattcttcgtcttctgctggtttttcaaagagtgcatttacaaaagaatcagcatcaaacttttgtaaatcttcgattttctctccgattccaatatattttactggaattccaagctctgcctgaattgcgatggcaataccacctttggctgttccgtcaagctttgtaagtacgataccggaaatatcagatacttctttaaactgttttgcctgcactaaagcattctgacctgttgttccgtcaagaacgattaatgtttcaaggtaagcttctggaaattctctttcaatgactcttcgaatctttgaaagctcattcataaggttcttcttattatgaagacgtccggcagtatcgcataaaagaacatctgcatgtcttgactttgctgcctggcaggcatcataaataactgctgccggatcagaaccttcctgctgtgcaataatgtcaacaccagctctgttagaccactctgtaagctgctcaatcgctgctgcacggaaagtatccgctgctgccataataacctttttattctgtgatttcagctgtgcagcaagctttccaattgttgttgtttttccaacaccgtttacaccaatcacaagaacgactgaagtacggttctcatattcgtaagctgtctcatcaacttccatctgctttttaataatatcaattaaaagctgacgacactcagcaggctctttaatatgttcctcttttaccctttcctgtaaatcttcaataatattcattgtcgtatctacacccaggtcacccataatcagaatctcttctaattcctcatagaaatcatcatcaatttttgagaatccatgaaaaattgaatcaagacctgaagcaatgttctttcttgttttggtcagtccgctaaccagtcggctgaaaaatcctttcttttctcccataactactcctttttaatttaaatctttgtcaatcaaatcaacagaaatcaatgtggaaatacccttctcctgcattgtgattccatacagggcatctgccgcattcattgttcctcttcgatgtgtgatgacgataaactgtgtgtctttcgagagtttctttaaatatttggaaaaacgcacgatattggcatcatcaagtgcagcctcaatctcgtcaagaagacagaatggagatggctttaagttctgaatggcaaataatagtgcaatcgctgtcaacgctctctctccaccagaaagcagcataatattttgcagtttctttcccggcggctgtgcgataattcgaatgccacattctaaaatattctcgttatccatcagttcaagagaagcagtacctccctcaaataaatcttggaaaaccgtcgtaaacatctgctgaatattaccaaattcctttgtaaactgttctttcatggcagtatttaattcctcaatcattgttagaagtttggcttctgcttctttgatatcatcatactggcctcgtaagaactcgtatctctcgccaacctctttgtattcttcaatggcgttgatattgatatttccaagttctttaatctgtctttgcagttcttttttctgtttacgctgttcggcagcttcctctgcttttacctcgtaatgcttcaaagtaaatgcctgattatatgtaatctcataagtttcccacatatagtcaatcttactttcaaaatcttctttcatgcgctcttgcttagaagataacttagcagcttctttttcaagaatcaacagcttttcattctcactctctaattcctgaaaaatctgattctgctttttcattgctgtggaacgctgctgctttaattcttcgagattggtggaaattccatccatctgtattgtaatctcctgcaaagctgctttcaatgtcttttgttcttcctcataggaaatattttcttcggtaaggcgtttaatttcttttttattttcctctagagagttcttgatattctctatttctttttcaatacgttgcttattactacgcagataatctaattcctgacgcatttttgaaagcgaaattctctgctcgttcttctcggattccagtttagaaacttcggctcttatttcagaaagctgttcttttaaggaatcaagtaccgtattgttctgctcatgaatctgttcattgtcttcctgttcttttaacagtgcctctttctgagaacgaatttcatcaatttgttcttttaaaatctgatgttcttcttttaatgatgtaattctttcagaaagttcttcttttttggcatccatatcaggaatctgattactcaggtcatgaagtaaaagcgatgctgcatccagtttggccttcctttgctgtttttgttcctctaatttctgctgtcctgcttttaattccgaaagagcttcctttctctcttcccaggcagccttcgcctttcttaaagaatctttgcactcttcaatctcacgctttcgaccgagaagattgccagaatgccggaacactccaccagtaattgctccaccaggatttaacagttcaccatcaagtgtaacaagacgaagactgaagttattctttctcgaaagagaaagagcatggtctaccgtatctacaacaacagttcttccgagcaaagaatctactaacgcctgaaaacgttcctctaccttcacaagtgtactggcaataccaataacaccttcatcttgtaaaacagatggggaaattgtgctgtttcttcttcggatatttgtaagcggtaaaaaggttgcccggccaaaacgattcttctttaaaaagttaatcatctttttagcagtctcattatcctcagtaacaatgttctgtaacgcaccaccaagcgcaatttcaatggcggtctcgtacttttccggaagtgctaaaatatccgctactacaccgatgatgcccggattggcattcttttgctccatgatacggcggatagactgattatacccatcataccgctccgtaatattcatcaatgtctcatagcgggacttcgtacgaaggtattcttgatttaagttccccatctcgtcctgatatttctgttctttttcctgaagatgtttttcccttttctcaagttcctgatacagattttcctgcttttcaaaggcctcttttgctgcatcctgctgtttgagcagttcttccgctgtttcgttatattcctttaattcggagttaaaagaaatatagcgactgttatattcagcattacgaatctctaactgttcttccattgccgcataacggctcagtttttcctttgtgtcagaactggtgttcataatcgaaaagagacggtcattctccccggaaatcttcttctcgcaagcttcctgttcttttctttttgtaagaatggactcttctaactcttctaacttcttttgtccgttactgatttcctgttttttttgaacagtttctttttttaatacctcgatttccgctgtttttgtgtcttttttttcatcactctgtttttctaactcttcataatgtgtaattaaaagagtgttcgattctactttatgagaaagtaaaagaatctcattatctttcgtctcttttttccggcgaagctcttctttttctgattcctttgtctcaagactttctgtaactgcctgcgtctgatcctgaagctttccattcttttccttaatcttttcgtatatctttctcgtatcctctaaatctccggaaacgattttgtactggcgctcattttcctcctgctcttttttcagtcgttcataatcataaaggaaaagatgaatatcaatatctttttcttcatcacgaagttttaaatattcctttgccttcgcactttgtttttctaacggaccgacctgtttttcaagctcagccagaatgtcggtaacacgctctaagttttggcgttcctgctctaaggatttctcagtaaccgtacgattctttttatatttggcaattccagctgcctcatcaaatagttctcggctgtcttcaatcttgccacttaagattttttccacctggccttgtccgataatcgaatagccctctttaccaataccagtatcgtaaaaaagctccacgatatctcttcttcgacaggaacttccgttaatgagatactcactctctccagaacgatatactcgtcttgccaccatcacttcctcataatcaagaggaataatacggtttgcattttcaaaagtaatcgccacataagcaaatcccatcggtctcctgctttgtgtaccggagaaaataacatcttccatcttcgaacctcgaagctgtctggcactctgctcacctaaaacccagcgcaccgcatctccgatattactctttccacttccgttcgggcctacaatacctgtaattccctgtggaaactcaaacacgatcttattggcaaaggacttaaatccattaatttcgatactttttaaatacatactacctccgccgcttttttaacaacagtatcgtctgataagcggcaatctgctctgctcccttttttgtctttcctttaccgatagcatatgtcttaccaccgattttggcttcaacggtaaactctttattatggtctggacctgcttctcttgtaaggacatactcaagacgtggatcaggacctgcctgcaccatctcctgcaaaatcgttttcgcatcataaaataaggatttatcttctacatcttttaacagatgtgtatgaataaatgttctcgctctatccattccgccgtctaaataaatcgctccgatcaatgcctcaaatgcatcggaaagaatagaatctctttctcttccacccgttgcatcctctcctctgcttaaaagaagatatttgccaagttctacatctcttgcacagatagctaaggtatactcacatacgagactggaacgaagctttgtaagacggccctcattataacctggatattctctgaatacataatcagaaatggtaacctctaacacagcatctcccaaaaattccagacgctcattatttgccttccttcgtcctctctgctcattcgcataggaactatgtgtcattgccagtgctaatgtacgcttatttgtaaaagtataacctatcttttcttctaatcctttaaatctctctgtccgaatcattactgctcgcctgccttctcttcttttgcctgtgccatttcttctgcaagatgcgctacaatcttttcattaatacgctgctctttaaaagtaacacactggaaaatggcagtctttgtctcttttgcctttgcacttccatgaatctttacaacaagtccctttaaaccaagaagtggtgctccgccgtactctgttgcatcaaatgtctttaacgtatcttttaaagcaggttttactaaaagaccaccaatcttacttcttgttgtggacatcattccttctttaattacatgaatcaatgtgctggcaagaccttcctcaagctttaagatgacattaccaacaaacgcttctgttacgataacatctgcctcaccctttggaatatctcttgcttcaatacttccgataaaattaatattcttacatgcctttaataaaggataggtttcctttacaagtgcattaccttttgcctcttctgcaccaatatttacaatagcaacacgaggattctttacaccgacaacgtcctccatataaatagaacccatctgtgcaaactgtaaaagatgttctggacgggcatcgacattcgcaccgcagtcaattaaaagcgaaacccctttggctgttggagtaagaggggcaagaggagctctctttactccttttccctttccaattaagacctgtccaccaacaagaatcgctcctgaacttccggcagaaacaatggcatcgcactcgccgctctttacagacttaatcgcaacaactaaagaagaatctttcttcttcttaattgccattgcaggagcttcattacaactaatctcctccgttgtatgagtaatcccaatctgttccttattataagtatatttattaagttccgtctcaatcttatctttatcaccaaatagacgaagcttaatatctgctctttcgttaatcgcctcaatcgcacctttgataatctctgcgggtgcgttatctccacccatcgcgtcaattgcgattacgttcttatattccataaaaggctcctttcctttaagaaagtactctcggaaaatcattttacaaaaaccttccgagaatactttgcaattttattgtaagttttatcatataataaagtcacagactagagtaacacaattgggagaagatttcaagaatgcagattactatttaattcattaagagacagacacctgagaagaaaaccgataccctatagttgtggtctcggagcaagatttagatgcgagtgcataaagcgagcatttaaactgcagcgactaatgtcacaaacaaatatagggtatcggttctcttcccgcctgtctttaggtggattttgtttgaattaaatttaatttcataacatgaatttttcctgattcatttttcttttgatgaatacagcgctgtcctacaaagtgtatttctggattctttgttacttctattaaattttcaagatatgtttcacctgttacgaaatcttcttcttcctttgccatatgtacagcaatcatagaacttgacagttttccgcaaagatgaacaacgctatttgaaaggaacttctctatttcttttaaaagcatgaatgtagccattccactacactctttaaaacacttttctccaaccatatccattgttgctgttggttctgctaaagaaatgattcggcagcctgcctggatgacagctttgatatattctgcttcttctaatacaatctttttcaatattttctcaagcttttctggttccgtttgcattgccagatacagtttcataggatcaatcaaggctgctaatatagaaaacggagcttctgcttcaaggataagaggcttttcttttaatttctttgtaacctctatgatagttttaatacgtttgtcttgcataagagtaaactgttctggttttatttcttctaacctagaaaaaggataatctcctgttgtccagtaattttctctttttataacatcagctccaagaactgcgccttcaaggttctgaacaagaggtaatataatttctttccgattttctgcctttttccatgcaagcagaactttagccatctcttcttcatttgaaagaattgataaatctttttcccatagccatcggggcatcgttcttttgtcgtctccattgcatttccatatttgtcccattctcgcactctccttagaagcaaaaaatcttattaggataataaaaaaggatactgtaaagtacccttccttaagtgatgttattaaaacgtgggcaagaggattcgaacccccgaccttttggtccgtagccaaacgctctatccagctgagctatgcccacaaattattaagatatgccggcgatcggaatcgaaccgatacgggagtataagtcccgcaggattttaagtcctgtgcgtctgccagttccgccacgccggcacaaatgggacctacaggacttgaacctgtgaccctctgcttgtaaggcagatgctctcccagctgagctaagatcccatgtaagtagcgggaataggatttgaacctacgacaccacgggtatgaaccgtgtgctctagccaactgagctatcccgccataaatatatattaaaaatggaactacaaggtgggtagagggattcgaaccctcggcctccagagccacaatctggcgcgctaaccaactgcgccacacccaccataaatcagaaccatctgaaacgtgcctgaagggattcgaacccccgacccacggcttagaaggccgttgctctatccagctgagctacagacacataagcgggtgatgggaatcgaacccacgtatctagcttggaaggctagtgttctaccattgaactacacccgcagatatcggggtgacaggattcgaacctgcggcctcttgatcccaaatcaagcgctctagccaagctgagccacaccccgatatagaaagtatgattaaatataccttcaaaaccacacacaaactatcttcttctattccaataacttactaaggtcaagctttcgaccgattagtaacagtcaactccatgcatcgctgcacttccatctctgccctatctacctcatcgtctctaaggggtctctcactctttcgagtatggatatctcatcttgagggggcttcacgcttagatgccttcagcgtttatcccttcccgtcttggctacccggccgtgccattggcatgacaaccggtccaccagcggacggtccatcccggtcctctcgtactaaggacagctcctctcagatatcctgcgcccgcgccggatagggaccgaactgtctcacgacgttctgaacccagctcgcgtaccgctttaatgggcgaacagcccaacccttggaacctgctccagctccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctactttcgtacctgctccacccgtcggtgtcgcagtcaagcctccttctgcctttgcactctctggatggtttccaaccatcctgaggagacctttgagcgcctccgataccctttcggaggcgaccgccccagtcaaactccccgcctgacattgtcccccgcccgggtcacgggcgcaggttagaaacccagtactgcaggggtggtatcccaacatcggctccctcacggctggcgccatgagttcttagcctcccacctatcctgtacatgcaataccgaatcccagtatcaggctggagtaaagctccatggggtctttccgtcctggcgcgggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaagttcaaaccttcgctcgcgctaagctctccccttaaccttccagcaccgggcaggcgtcagcccatatacctcaccttccggtttcgcatagacctgtgtttttgctaaacagttgcttgggccatttctctgcggctgcttgcgcagcactccttctcccgaagttacggagtcattttgccgagttccttaacaacacttctcccgccggccttaggatcctctcctcatccacctgtgtcggtttacggtacgggcccttgctacacgatagcggcttttctcgacaggaaggggccgcagcttcactacttcatttcgctccgcatcacgccttcgtcttatgcagggcggattttccaaccctgcgactacttcgcttgcaccgggctttccattcccggctctgcttcccttcccgtgtccccgcagttctgataacaaggggtgcaggaatcttaaacctgctgtccatcggatacgcatctctgcctctccttaggccccgacttacccagagcagatcagctttactctggaaaccttggatattcggccgcaaggattctcaccttgctctcgctactcattccggcattctctcttcttagcggtccacatccccttccggtaatgcttcgctcccctaagaatgctcctctaccaacccttacgggttccgcggcttcggtgtggtgtttcagccccggacattttcggcgcaggacctctcgaccagtgagctgttacgcactcttttaatgaatggctgcttctgagccaacatcctggttgtcttagagatcccacatccttttccacttaacacccactttgggaccttagccggcggtctgggctctttcccttttgactgtccaacttatctcgtacagtctgactcccatacaccatctgtccggcattcggagtttgatattctttggtaggctttgacgcccccgcggaaattcagtgctctacctccggcagacttgtatgaggctagccctaaagctatttcgaggagaaccagctatctccgggttcgattggaatttctccgctatccacacctcatccccacccttttcaacggatgtgggttcggtcctccatcgccttttacggcggcttcaacctggacatggataggtcacccggtttcgggcctgcacgtactgactaaaacgccctcttaagacttggtttccctacggctccgcacctgaagtgcttaaccttgccagtacccgcagctcgccggaccgttctacaaaaagtacgcggtcgtacctgagaagtacttccacagcttgtagacacagggtttcaggttctctttcactcccctcccggggttcttttcacctttccttcacagtactatacgctatcggtcactgagtagtatttagccttacggagtggtctccgctcgttcccacagggtttcccgtgtcccgtggtactctggatcctgccgggtcagctctggcttcggatacggggctctcaccctctctggccggctgttccaaagccgttctcctgccgttactgaatcccttatgcagtccgaaccccgcgatgcacgcatcacggtttgggctcttccgcgttcgctcgccgctacttacggaatcgatgtttctttctcttcctccgggtacttagatgtttcagttccccgggttcccttccataagctatggattcacttatggatgactgtagtccatacagccgggtttccccattcagagatctccggatcaaaggatatttgctcctccccgaagcttatcgcagcttatcacgtctttcatcggctctcagtgccaaggcatccgccctgcgcccttcttcgcttgacctttgtatgtccatttcctaagaaatggctgcctcctgttcctcctagcgtagagaacattcggcgtatgagttaaaactcatgtttcgtctttcgacttgctattgggagaattgatttagtctcaattctttcttatcatagaaatctgatgtcgcttttctttaagaaaaactttctgtgtgcagttttcaaggtacattatcatgcggtatccaactttatcagataccaagtggagaatacgagattcgaactcgtgacctcctgcttgcaaggcaggcgctctcccaactgagctaatccccaagggaatccggcagccacctgctctcccatgccgtctccagcatagtaccatcggccgctcaggtcttaaccatcgtgttcgggatgggaacgggtgtgtcccctgagcgcatcgccaccggaaatatcttatcaagtttttgcttgataactgaataacaaaacaactctctacttgtcttccttagaaaggaggtgatccagccgcaccttccgatacggctaccttgttacgacttcaccccagttaccggctccaccttcgacagctccctccaaaaggttgggtcactggcttcgggcatttccgactcccatggtgtgacgggcggtgtgtacaagacccgggaacgtattcaccgcgacattctgattcgcgattactagcgattccagcttcgtgtagtcgggttgcagactacagtccgaactgggacggcctttttgtggtttgccccctcgcggttcgcctcactctgtgaccgccattgtagcacgtgtgtcgcccagatcataaggggcatgatgatttgacgtcgtccccaccttcctccaggttatccctggcagtctctccagagtgcccagctctacctgctggctactgaagataggggttgcgctcgttgcgggacttaacccaacatctcacgacacgagctgacgacaaccatgcaccacctgtctcttctgtcccgaaggaaaactcccatgtcaagacctggtaaggttcttcgcgttgcttcgaattaaaccacatgctccaccgcttgtgcgggtccccgtcaattcctttgagtttcattcttgcgaacgtactccccaggtggaatacttactgcgtttgcggcggcaccgaagcctatacggccccgacacctagtattcatcgtttacggcgtggactaccagggtatctaatcctgtttgctccccacgctttcgtgcctcagtgtcagtaacagtccagcaggccgccttcgccactggtgttcctcctaatatctacgcatttcaccgctacactaggaattccgcctgcctctcctgtactctagccgagcagtttcaaatgcagctccggggttgagccccggcctttcacatctgacttgcactgccacctacgcaccctttacacccagtaaatccggataacgcttgctccatacgtattaccgcggctgctggcacgtatttagccggagcttcttagtcaggtaccgtcattatcttccctgctgatagagctttacataccgaaatacttcttcactcacgcggcgttgctgcatcagggtttcccccattgtgcaatattccccactgctgcctcccgtaggagtttggaccgtgtctcagttccaatgtggccgttcatcctctcagaccggctactgatcgttgccttggtaggccgttaccctgccaaccagctaatcagacgcgggcccatcctgtaccaccggagtttttcacactaggagatgtctcctcgtgcgcttatgcggtattagcagccgtttccagctgttatccccctgtacagggcaggttacccacgcgttactcacccgtccgccactcagtcaccaatcaatcatccgaagaatctcaaaaggcgcttcgttcgacttgcatgtgttaggcacgccgccagcgttcatcctgagccaggatcaaactctcaaataaaatgtttaagatgtcagatcaaggtccagaaccactggttcttttcctgtcattactgtttatttaggttttgaactttcgttccgttccatggactttcctgcagacatcactctcaggaaaacccgaatgaaatttgaattaacgttcaaggttgttttgttattcagttatcaaggttttgtgttttctttcgaaaacgcttaattatattatcacattctcatatctttgtcaagaacttttttcaagaactttttcttctttttaagaagtccgttctcactgtcaaatgtgaacttttatatattatcacatgattctcaatctgtcaagaagttttttcattttcttttaagattcttgtcatttttcttttaaaaatgagtttctcatgtacaacgcatattatattatcataacagtagagttgcgtcaagcattttttgaagatttttttattttatcaacaagcactagatattgtattttttctgtatttttatcattcacgctgcatatccggcttattgaattgttatttttttatcaacatttaaacataaataatatcaatttacaaaaatagcatagaatattccttaaatttttccaaaaagatagctctctataattcttatttacagattcacctctaaagtgtgtttggaaaatcgttcctgtaatctgctcatctcgcagcaagaatgccagggtattcttgaatttgcctaaatacagttgacatagcctgctacacctctgtattcaggcaaaatataccacaaattataacatacattttcgtttaatccataatagaactgaactaaataagaaattatagagggccatctttaactcaaatgcctattaacgaatattaaatttatactttccaatatctaccgtttcttttttgcttacaaaatcccactttccttcataatatataattgtcacaattgtattatattctaacttatcaagaattggtactgcccaactttgtggaaccatctcatattcttcgtttgttttcctatcagtcataacatacatatcgttatgtttatgagtatattgcacatttttcaacacaacaggaattcttgaatgcggttcattccaagctactgcttcatgattatattcatcgtctacctgagattgtatactctttaatgcttctttacgcatgcttccgttattgcagtaaagaatcgctgtcctcttcttaccggtagtgagactcacaagggttgccgtattacagatagcctttgcttttccccagccaagttcggtctcatgattttctgcttttataagtacaaatggactttctaataattcttcttcatgtagataaatagcttcacctactttcatctccgaaatgcaacgatattttctattattatctatattcttattatctaaatcctgcattttttctatctgggcacttgtcaaagtttccagatcttttttcattttttcttctatatctatgttcgtatttccaatctctgcgtcatcccctgtatcttcttctgcagcttttttataccattcttctgctttctcaatgtcttcttctactccaagtccatgctcataaaattgccccaacttatatgctgcatctggtcttccctgctgtgccgctaacatataccaatgcattgccttttcaaaatccttttccttgccctttccctgttcataacatcgacccacattatactgtgcctgtgcgtatccctgcaaagctgctttctctccccagtgaatcatctcttcataattcttgtctacaccttttccataaccataaaaatgtgccaagagtgcctgtgccggcgcatattcctgttctgcagactgtacacagtaatcaactgcccttttcatatttatacttgcaccttttccatttgcatatgcccttgccaaatgatattgtgcctccatatcgccagatttcgcaagtttcttccactctttcacttgtttactctcaaaactaaataatcccatattccgtctcccctcttgtgttcaatcgtaagttatgcattgattatactttaacaatggtattatatcacaaaaaagcaggaaaaagccatcgaattttataaaaattgaacaactttccctgctaatcaaccgctactgctatttacttcttcttaatgtgattcctgtgatattaaatccataggaggacttcttatttttctttaaagtaagagttacctttccaagtggctgcgtctgatctgcatatgcatcgtacatattcaccttaaaaacagccttccactttttcccttgttttgttaccgattttaatttgtaaaccggataatcttctccccactctccaacagcaagtttcacataattcgagttacaacgtactactaattccttaggtgtttctggatatgttttaaaagatagagaagcaattcgtgcattcgcaccaaaaagttcttttacacgctgactgaatgcaaaattggtaatacgactctggccttctaatacctgtcttcctgccgcaacattctgcttttcaagcgatgtaagctttatcttttttgtctctccggattgcatgctgtaatttaaacgaatactataataaagttgtgttgcctccaatatacgattcatctgctttctatacttaactgttacattcttactctgtttcttaccgttcttagcctttacagtagagactgttgttttcgcagcaaatcccgtagatggaactgcaataatcaggattattgccaaaataaaaaagcttactaaaagctttggggttctacatttcatatttctcatcttccttttcattctgtcttttctttccttttctcattactgtccttattgtattctttttaagagaaatgttcaacgcttagactttcttgattttttccctcttacatactccactctttctattaaaaaagcgaaagagaaaaactccctttcgctttttcttaatttgttaaagtaaactcatatttcatctctaatgttacaaaaagctgctgcattaccttatttgcaatttcacgaatatttaagttctctatataagacaaaatagcttcttgttcttcttgtggcactttaaacacagataaactcattgaaagaaagcgtgccagcttacgttctaatgtaaaatacatatcacaaggtcttgccatataacctctcataaacgcagcggtaccaatctccatttcataaaaatcacttgcactataacctggtaaatacggagcaaaaatcttttgcaattgtactgctgtttttttatgaataagttctatattttcaggtacagtatacgcttctacataaatttctcttaaattttcatttaattctgcaagtgtgagctgaaggcaagtttctactgcatataataataccggatttgtctcttctcctacaatcttacctgaaatattaaattgattgccaaacataaattctgtaagttcggtcaaaatactccctttcgtatgataaatattataaaacgtactcggtgttacgtcggctttttttaaaatttcaactgtggttgtcttttgatatcccttttcaaggaacaactgcacacaagcagataaaattcttcttttggagtcttctttttcgtatctactagccatttttcacccttctaactatttcaatatgtattttaatatattacatttttctttgaattgcaaggttaatggctggaaactttttatttggtgattttcacagattttacatttgaataacttccataaatgtttttaccagcttttacataataagctcttactttgtaataataagttttattcttactaagtgaagtatcttcataggtaagttttttcgttgttgtaattttactatatttacccttttttccggttgctctataaatttgatattttttagctccatctgcttttttccaggataaacttgccgttgatttctttttatttttcactcttaaagacactttctttaatgtgcctacttgtaatacaacatcactggcttttccattgatcattgttgatccatttttataataagctaccactttataataatagttttgaccacctgctattgaagaatccgaataactaagagctgctgttgtcttcaacaattcgtattttccttttttatttttcgcacgatataccttatatcccgatgcatttgttactttcttccaacgaattatcgtagttccattgctggattttgctgtaatacctggttttccaaccaaaattctcgtaccgcattttgtacatttaccagctttccactgatgtgctgccttttttacggcaacagcgttacaacagccatatctctgttcatgtgttgttggtgttatgatccattttaccttttccacatgattagcagaatctaattccccatattccattttgcaaatatcacaaatcgcttttgctttacaagttgctttccctccgatatggtgatcattgatggttactgtaatctctgtaacattatcataatcgtcagtagcggttataacctgtttaccgcttcctgaaagtacatattgattattttcatctaattcaatgcggtttccattcacttttacatctcttaaatgctcatcggtcacagtgattgttcgagtaagacaatagatctttccatcttcaactccactaattttcggtagagtcatatcctctttaatattattatattctaatgtttttgtggctgactttccaaacttatccgttaatcgaatcgtatacgttccattctgcgtaataacataaggaaaacctactcccaatttctctatcttagtataattctcatcgccttctctcttaatttcacaacttgctgcttcgttattttcatttgtttttttcattaaaacgacaattcggttactctgcattggatgtatcgtatctgcatttgctacgtcaatactaaagtctccaccctcgtatttgcacgtaatggttacatcttctgttttaaaggttttaaatgctccatcttcttttcgggtcttcgttactactgcataaaccttcacttgtttttcatcttttatatttgcaaaaatatcctttaaatcaaccgaaacgctgtctcccgtaagatccaagcgagtagcttttccatctttcaccatgtaatactcatacttgtagctaatgctgtgctgtttttcataatctctataaccatatagaataataataaagggatcccttaacactccaccgtcaagttcttttgttgttgtaagaagctgtactttactatccgtaagattggtaatcgttccttcattactgtagctgtcaaaatctcctcgtttcacataaagattataggaaaaatcctttacttccggataggatgcttcgattgtaatttcataggtcgcatctttatttacagtgtcaaaataaaaagaatccggaaatggtcctcgttcattttctttttccacaccgtccatccttgtaactttcaactctgtaccattctcttttacagatgtaactttataaaactttccactatcatatacgctaggaaattctaacgaaatccaaccaccttctggcacatcaaattctatatcctgacctgtgatctgctttgtagctccattataatctctttgattataagttattatgtctttatccgtcggcttaatattccattttaacttaatattggccttattatagtaatttgcatatacttctttattctcattcggcgggtcataatcaaatcccggattttcgcccaccttataacttgtatagtccccatcaggtatcatatccagtatctgtctgtaaatatatccccattgtttctgcaactgcgataaaggtttctttgtgtatgaatagaaagttttgtattccttatatttaggctgtggaagcttatctgaatgtttatactcgacttctttatcatgtattgtatatgtattttccgcaaggtcctctgcatgataaagatatagcggctggctattcgttgtaacttgaagtccattcgcatctacattcaggaaaaggtctcccgttttattatcaacaattcgaaataaataattacttcttggcaccgggtttacgatccattctgttttactgtttttagaaaaccccaatttatttacattacgatcaatgttcaaataatatttgacatcctgctttataatgtaaatatagtaatgcgtatccgtacccttctttttttgaaattttaaaccatattccttaatattttttctatttcgctctgacattttttcgtccatacgcaacactatggaacccattcctttacttataattttaaactcatcataaagcattcccctggtaggatttgatccgtcacggatcgcaatttcatccatattatgacaatagtaagcatacttactctccttgccggcaagatagaagtttttcttctcagcaatgtccgaatacaaagtatctatcggatttacataccagtaataggagtatgcatgtaccgtcttaggggcaaaaacaaaaataaaacaaaccataaataaaatagctaataattttttcttcattgtcttttctcctttccattctcactttggaatacattccaatatttatattgtatatagtaacatacaatccaacgaattacaagcatcaaaaatgacaatgacacatttcaatattttcccatcgtaatccacccactttaccgattctctttttgttctggccagataccctagaaatatttcctgttcttcaacagccaagactcttcgttccactttctcacatttagatattaccactttcataataatctcctagagcgtgtttgaaaaaggctctagatgaactgtataattcttgcaagctccataaccacgactttcagcattactccactggacatcacataaaaccatatttcccgcattcgttgtgattttgcgattggtgttgctactgctgcaacaataatcattgcagctccaatacagccaacaatagtaggaatacttatcagcggaaatattcctggtatacaacttccatcaactgccgcctgaatggtcttatccaatccatccctggccgctgcaaagcaacaaatgacaagaccatacatcagcaaaaataaatttctacatccccaataactgatcgtgttacgattccatacagaatatccaataaatccaactagagcaattatcataatagtcgttactgtagttaccatatttccaaaataaagtttcataacttacctccgatcatcttttaccgttgtaccaactaatcacgccctgcaggttctgtatcttgacacgttcaccaccatgcaacatcatatccagcatatcctcctcttccggagttcgatctgttttcttctccagtgcttttcctgctgtttttaccataatgttcatcatcattttgtacatcccatgaagtctttctacactgaaatttccctgcaatgtaaatacaggaatctttcctaaggtaaaaaagacacaatacgattttgcatccgtactgcgtctaagcgtctgacttttccatattcatttttcatctacaggacttgccactggcagcttcttttacatacttttgcatccgatcagcctgactgtaaaaccctctgcgtcaattagactctcctttttacattttgggcaaaatagtggaaaatgtaaaagcacggtgtcttttcgcaatctcactcttgttttatttccgcataccggacaatatacccatttctgatactccatctcgtccttgttcatttttttcaccttaagtcgatattttttggaatattttggcaattttctctacatgctcctctacttgtttcactacttcctgtttattctctgctccatcataaatgctgtataaaagaaaaataggtccgtagaaatccattgcaagttgctttgcatcttcaccgctttctacaattccagaaaaaacagcttccatgtaccgaagtggaccttccgcaagataattctgatagagtttagccattttaggatctctgtactgttctaatgtcagcatttttcggaaacaacaggaaaattcttcttccgtccagtgcagaaactgtacttttgtaaactgtctgatcttttccaaagcaatgtttttatatcctgcgatcacatcctccatatcgccatccggcatttcatattcctttgcccttttgacatccatctggttcattctttctacaatgctgtccaatatttcctgtttactggaatagtgtttatacaatgcagccttggtaactcctaatcttgaagcgatctcattcatagacgttcccatatagccactttgtgcaaacaattttaatgcttcttccagtattttttcctttgtgttcttttctttgctttccatatttctctcctaaattgatgttattagcaagttaccttttggttacttttattatagttacctatcggtcacttgtcaacacttattcttttaacacaaaagaaaatatttaacttcatcatcgtttctcgataacctgatctatcaatccatacttactctgctatcaatatcggaatgccaccattctgcattccatgcaacaattggcttctatacttattctgccccctacttttaatggtttgatctccacaaaaccataagaaataaatgctgcaactccaagcagtctgcaataatttataaaattctttttcttcattttgttgcattctccctacaaaaccattgcagatattcgtcaagattgtttctttcctgattctctgttttacattctccacttcgaaggtccagttcataatccataagtccatgaactgtcattgcaaaacttactgcactcatatctgcattttgaaaatgaagtaatttgtgtacttccattgcatagaataactgtttcgtcgcaatgatcatttttcctgtttcctctgccagaattttagcagccatcggctggatacttttgatctgcataattcaagtacgggttagaataactgacctggcagttttttcttctctttataaggaaacatcttatcaaattcttcggctttcttttcatctacaaaatatcccgctggtgtcgcatactctccagtaataccgtttaaatatccaggaatcagctctttgcacagaaagaaagatgcatcctgcccttcttccagtccatgataacgaatgttaaattcgcttgccggtctgaatccactttttccataaaaatcaatgtttccctcaaagcagactgcaccacagccaagtttcgctgccttatccaatgaataatccagtaaggcttttccatacccttgtcgttttaattctggagtaatacaaatcggtcccatagtcataattggaatatttcttccatcatccgatttaatagccgttctcataaacatattctgaccgatcagcttgtcctctttgccattttcattaagaaacatcacaaaatccagttccggaacaaatgccagatcatttctgagctgatgcaatacataatgctcaaggcatcctggacgatacacattccaaaaactttctcttaccagattttctactttctgatgttcttcctttttctctaaacgaatcataatattacttttttccatttcttttatgtcctttcttaaaaataaaaaccgataatcctggtttttcaatatcagaattaacggctctgcgtcttaatcgtctggctcttattttactgtttcatttcttctacaattttgtccagcatatattcaaactgacattttgctttcgtcttatctgttgctccatcatatacactataatagaaaaacatatttgcataaaatttaactgcttcctcttctggattttttatttccatatttttgaacagatccttcacgtattctgccggtccggataccagatattgctgatataaattctgcatctcttcatttctaaattgttcaagcgtaagcattttacgaaacgatgatgcaaaatcatcctctgtccaatactcaaacattgatttgctgtatcctacaaaatcttctactgatacattctgatattcttccggcacattctcaatactttcttccggtacttcattctgcctggcctgttcgctgtcctgctgctccatacgctgcacaatacagtcaaaaatatctcttttgcttttgtaatgacggtacaatgccccttttgtcatatcaagttctcctgctatctggctgacggagacagcctcgtaaccatctctggcgaacaaatgcagtgccacaattaatatttcctctttcctattacccatgcacatttcctccaaaataaataaacgaccgtttacatctcaataatagtaaacggtcgtttatttgtcaagacttttctttttgcttatattatctctttttataaatcaataactctggattttcaccattcttctcatatgtacataccagaataaaatccatatttgccagaatgccaaagcatctttctgctctgaattcagactccagttgattccccagataggttttctgatcatcaaggaatttcactttttgtccgttcggcagttgatattcaagattcacatattttcccacaagtgcatttaatttgtctacccttggaagtccatctatatgcagatcatttatttcgtttatcaattgctttttaaactcttcaaactgcccattgtcactaagttcatcatatcttttccagtaatctaactttggaagcatttctttcaaataagatcctgcctgtttttcggtaaagttttcatttaccatattctttacacacacatcaatcaattcgtccatatcgttatatgtatatgttccatctgcatagcaccattttcccaacgtgatactgcctgccttgttaccatgattttatctgccagctcgtcttgtgacattcctctttccgtgcgaagtttcaaaataatattttttgttttcatagtggtcacctccataaccatatcatataaccaaatccatattccgaaaagcaacttgctgttgccatactctatctaatagagatgtacgtacttccatacttctgaatttgtgctgtaatagctttttccgtactgaattttgagtgcaaatttccataaaaatactggtggcaacgtggagtttcttgtattttatttcaacggaaagcagatatctatttccatatatccattttctcccaccagacgataaatatcaaaaatcggccgtctttcatctaattgatttccagtttttgaaagccatctgcaaaatatctcctgatataccatgaaaagaaactgaggaaaacccttaaaatgatatgccgcatattttcctccttggaaatgtttagcaaaattacttgatacaatcactccagttgaaaaatattctccttcaaacgtcgaaacggataattgttctattttttcaattaaatgtgcaaattttattccattatgtaaattagatgaaacacagtttgctataagcatttgtgcaaatttatcgccaaatagccaatctccacctttaaatttttgaaaataacatgctgttaactgttcagaaattgcttctgctattctagggaagaaattttttgctaagttcatctttttaatatattttctcaccagaacatatggataataagcaattaactcatcatccacataaatttgtgaaactacgcagatttcattctctctttcctttatttcattcactgaattcaaactgtgaatactcattttactcaatctatgacttgagtaatactcaatttgaagtgattttagacggtttttaacggttcctggcgatactttcgccatttccttttttccatagaaaaaggctccgaaaacctcataatcactagaaaataaagtgtttatgaaggtttcggagccttttataaattctattttaatttacagcattaataattcaaggaattatttgccagccatctgagctgccacctcagctgcgaagtcctcttctttcttctcgattccttctccagtttccatacgaacgaaacctttgatagcaattttagcattgttagccttagctacttcctcaacatatttggatacggactgttttccgtcttcagcttttacatatacctgatccattaagcagatttcttttaattctttgttaagacgtcctttaaccatacctgtgataatcttatcattagcatctggtttttcattcttagctgctgctgtaaggatttcttcttcttttgcaagataatcctgatcaacttcagaacggtctgtatacttaggatttaaagctgcaacctgcatacatacgtttttagccatctcttcgatgtcagcgttaacaacgtctgttgcaacgtctactaaaacaccaatctttccacccatatgtgtataagaagctacgaaacctgcatcttcttttacctgctggaatctacggatgttcatgttttcaccgatgatagcaatctgtcctgctaatgcttcgtttacagtcttagtctcatcaaatttccatgtttcagctaagaaagcatcgatatctgctgcttctgtttccatagcctgctctgcaacctgtgcaacgtaagcctggaatttttcgttctttgcaacgaagtctgtctcagcgttaacttctactgcaacagctttcttcttatcatcagatacgataacttttacaagaccttctgcagcaacacgtccagctttcttttcagcagttgcaagacctttttctcttaagaattcaattgctttatcaaaatcgccttctgtagctgtaagagctttcttacaatccatcattccggcacctgtcatctcacgtaactcttttacctgttttgctgtaatagccatttcgattcctccaaattcatctcttttatgtgtttcatatagattttacacaaaaatgccccggcctgtaccaagtgcaggctgaggcgattattgcaaacagaattaagcttctgcttcttcagcagcttcttcctctgctacttctgcatcctgtccctgatttccttcgattacagcgtcagccatcttggaaacgattaatttaactgcacgaatggcatcatcgttacctgggataacgtaatctaattcttctgggtcacagttcgtatcacagataccaactaaaggaataccaagagtttctgcttcctgaatacagattctttcttttctagggtctacaacaaagatcatgtcagggatatcctgcatctctttaataccgcctaagttcttctctaatttttcctgctgtttcttgaggttaattacttctttcttaggaagtacatcaaatgttccgtctgcttccatagcttcaatcttctttaactgggcaatacggctctgaatagtcttgaagtttgtgagcataccacctaaccatctctggtttacatagtacattccacatctctcagcttcgttcttgatagaatcctgagcctgtttcttagtaccaacgaaaagaatctttcctccgttagcaacacagtctctgattgcgttgtaagcttcgtcaaccttacctacagatttctgtaagtcgataatgtagataccattacgctctgtgtagatgtaaggagccattttagggttccatcttcttgtctgatgtccaaaatgaacacctgcttcgagtaactgtttcattgaaattacactcatgtcaaatctcctttttgtttgttcttccgctgctttctcattcctcagccacctttgttcaggcacttcgaccgacagaatccggcaacgtgttttttataacttaatttaccgaacgaattatatcatgctttatgttatattgcaagaaaaatttcaaataatcgcttaaataatttgttttctcttaaattactatttatttcaattatgacatcctcccccacctcgcaagttcggttctcgtccgataacactactgtgctaagcataagcgagctatccccgtgggtcccacggttgtgttatattgtataaatagtatgatctacttccttccgtaaattattaatagtattttattctacaaatcatttgtgaagttttatattattaaagtgttttgtaaaactccttaatctccaatgccatctgtttccgacggtctgctaaaattttggtaacatctttttctccggcagtaaatatctcttccgtaagaccattttcctgtaaggaagctgtaattgactctcttccgattatctcttctaatttttctctataatcagctggtgcttttctttttacgatatcctttgtctcttttgaaatgtaagtaaggtttgcaacctgtccgtagatttctcttgttttatatccacatttggcaagataggttttcgggagaatctgataggactctgttttatttttataaagttcttctattgttacatcactgaaaagagaatggactcctcttgcgcactgtgttgcaacataaacaaggaatggtgcagtacgtgctgttgtggaagcaaacttatctggaagaatactgtcatagaattcttctgtaagctttaattcttctatctgtgctaaataagaagcaaaaccttcttctgtagcattagcatagtctttaagtacagttccctctccaccactttggtagtgtccggtaagcatcaccatcgtcatccatcttgctaaaagagattccttttcttcttcaccgattccctgtcgatccataagaaggtacattgcgtagcagtaatttaaaacagactgtgaatacagcagacggctacaacaatatcccgctttctttaatgccttttggaatcctttaaaattcttctcacagacaaaagcccttacaccagcaccaagtttttcaaaagattcttctgaaagcttcttagatatttcttttttggtaagtccctttttctctccggttcttccggataaaagataaactaaatctccaattcgtacctttccaaaataggaaatgagtacaacttttaacacatctgcataagacggaatataaagattcttttccccattctggcaccatgcaacagcctgtccatactcagaattaaaaaagtctgtttcattttgctgtaatacctgataaaaggatggctctctaagtaaatgacagaaataatcaatacaatttcttatgtagtccccgccatactcttcattgacagaaatcttagacataacaaagtcttcctgattcagtggttttccctgtaaattaatacgaataaaaatctctgaaacaacatcaatatctaaaaggaaagaaagttcgatgacacctacctgatgttttacaatttcttttaatgtatccacggattcttccaaaggtgtgaaatcttctcctggattcgcctctttatattctttttcaaactgtctaaaagaaaaatctcttctaaaaaagatagaaatgtctggaatccatttgctatcctgttcatgcttttcatcacagactgcaaaacgctcatcacctgtttgcgctaacgggttaaatgcaatacggattctgcaagactgatactgttcatctaacacttcttttccaagaagcgctgccattaaagcagtgactctctgttgtccgtcaatcagaatcttttttgtaccgccctttccaaatccacggacacgtacctgagaattctgccatacaattaaatatccaatcgggtatccttcatataaagagtcgatcaatgctctgacttcctctcccttccatacaaatggtctttgtatttcaggaatggcaatctgggaattctcgacatagttaaggatactactgactgaatattgtgttattttatagttatccgacttcataaataaatcctttcgtatatcgcgggcaaatgccaactaccttcaggcagcagagatagccctgtcaatcttttgaagtattgttctgctttattacaaattcatattctctgttatcttatgagaatatttgttggaacacgttttagtgtgctgtcttattaatgaaatgtcagcaggacagtacattagtgtttcattttctttaattcatcaaaaactacatcattcagcactttaatataagttcccttcataccggaagaacgagattcaataactccggcgctctcaaacttccgaagtgcgttcacaataacagaacgggtaatccccactctgtctgctatcttgctggctacaagaattccctccgagccatctaattcatcaaaaatatgctgaattgcttctaattctgagaaagataaggtggaaatcgcagactttacaatggaaacttttcttgtctcttctgcattctcctcattaacagaacgcatcatttcaagaccaacaacggttgttccatactctacaagaataatatcatcaatttcgtaatggtgttcctttctgtacataaataccgtaccaagtctttctcctgcaatatcaattggagtaataattgcctgataacggtcaatctctgtatgttcaaagcccagtgtctcgagatttacattctcttttgtggaaagaacacctaataaacgctcattaagaagtgagtcaatgtaaccgcccacctcattattgattaattcatcaatcacttcgatatcctggcggttcttaataccaagcaccttacctttacgactgattaccagaacattcgataaaagaatattacttaacacctcgcagatatcattaaatactaccttgtgtgaattattattgtgcaacaatttatttatttttcttgttttatcaagcaattgaacactcataaatacctccatctcaattgttaaaattaacagacaattcttcaccttttatcattttaacatatcttcctggcaaccacaacggtattatctaatatttttaccacttttttaaattaatttataatttcgtacaattccaataatttaggaaaacaaaataggaatttgccgcaggcaaaaagacgccccgaagagagtctaacccctatatttgtgactttagtcacagatataggggttattctctctggggttcgtctgtctgcttcaccccggcaaattcctatttaacttcttctttgtccattacgaagccgcattccttatctgcacatacaagcttcttacccttttccaccatatatcccccgcattgtttacagcgaatattggaaggcttctgccagctcataaaatcacattccggattatcgatgcagccgtagtattttctacctttttttgtctttttaagaacaacatctttgccgcactttggacaacttacaccaatcttttcgtaatatggctttgtgtttcgacagtcagggaaacctggacaagcaaggaactttccgtgtggtccatattttactaccatatttcgtccacattcctcgcagacttcttcggaaacctcgtcttcaatttttacttcttctaattccttttctgccttttcaacagcctgcatcatatctggatagaagttttcgacaattgttttccactttacttttccctcttccactccatctaaaagagattccatattcgcagtaaaattcacatcaacaatggtagggaagccatcctccatcatatcgtttacagcctctcccaactctgtaatataaagattcttactttcttttacaatatatcttcttgctaaaagagtagtaattgttggcgcataggtgcttggacgacctattcctaattcttctaaggtttttacaagagaagcttctgtaaaatgtgctggcggctgtgtaaaatgctgctgaggatctaatccagataacgtaatctctgtatccttcgtaatttttttcattgcggcattcattgttgatttttcactatcatagctatataccgtcataaatccatcaaacttgactttagatgctgcaacattaaaacggtaatctccagctccaattttaacagatgttgtctcatatactgcttctgccatccggcttgctaaaaatctcgtccagatcaactgatacaaacggaacaaatctcttggaagctgttctttaagcattgctggtgaaagactgctgtcagttggacggattgcttcatgtgcgtcctgaatctttcctgtttttgatgactttactgccgttttatctccaacaaactgttctccatactgctgtgcgatatactctcgacaacttgcatctgcttcttctgaaatacgtgtagagtctgttcgaagataagtgataagaccaacacttccctttccttttaatgtaactccctcataaagttcctgtgcaagacgcattgtcttttgtgtagacatattcagacgcttcgatgcttcctgctgtaaagtacttgttgtaaatggcagtggcggcttctttcttctctctccattctttactgacaatacctcaaacttctctttttgtaatttctctaccagagcatctacttctttttgtgaatgaagttcaatcttaccatttttatctccagcaaaatgagcctccagagtttttttcgctcctggcactaaaatgtttgcgataaggctccaatattcctgtgaaatgtattcatcaatttccttttctctgtcacagatgatacgaagcgcaacagactgtacacggcctgctgaaagccctcttttaatctttgaccagagaatcggactaatcttatatcctacaattcgatctaatacccttctcgcctgctgtgcatccacaagattcatatcaatatcacgggaatttttaatggatttctttacggcatcctttgtaatctcattaaaggtaatgcgactgcacttcttgttctcaagttttaatgcataatacagatgccatgaaatagcctctccttctcggtcagggtcagttgcaagatatactttatctgctttctttacttctttacgaagctgagctaaaatatctccctttcctcgaattgtgatatactttggttcaaaatcattctcaacgtctatccccagtgtactttttggcaaatctcttacatggccgtttgaggcaataaccttatatgactttcccagaaatttctgaattgttttagccttggccggcgattcaacaataactaagtttgctgacattccccaaaacactcctaacttttaaatattatattgcaatttattgtattttatcactatcacatatttgaaaaaataccattagcaagatatgcgttacatttatggaataattttttcaaatacactctgctgaactgtcttaattaacatttataattcgcataaagaaaagattctataaggaaattatgttaaatatcaataagacaatactcgaaatcaaaaacaataaatgtactctttcataaaacaattatacatcatacactatttcgttttgccacgcaagcagaaaatttcacacttttcttaaatagacattttgttctatctgataaattatgttttttagttcaaatttcatcaggatatgttgcaattcaaaggcagaaaaaccgctattttccaaaagattttcaaaagtcatgggatgaatttcatctaagagcgaatatactttttcttcttttttattttcacaaaaaaatttttgttctttgaaaaatttttctctgtttacatccatatttttctttttatttcctgttttcccctcttttataattatatccataatgtcttctggagaacgaaccaggacagctccctgactgattaaatcattacatcctctgctcatacaatccgtaattcttcccggaagtgcaaaaatatcttttccttgttccagtccttgatcagcagtaattaatgaaccacttctcgcccccgcctccgtgacaaaaatcccatcggaaagcccgctgataatccgatttctcataggaaacaatcctttttgaggagaaatacccatattgtattccgaaagaactccgcccatctgatacacctgttgatataaattaaaattctctactggataaatcgtatcaatcccgcctccaagaaccccaagcgtatatccattcgcatctaacgctcccttatgccccgcagcatccactccggccgccatgccactcacaatctgaatgccacattctgctagtctttttgcaaattctctcgccatttttcttccatatatagttgcccttctcgcaccgacaattgcaagaattggctttgaaaaattcggaagtcttcctatataatatagcaaatttggcggttcatataactgtgcaagtctttctggatattcctgtgactccctgtgaaaaaaataaatttctcgtttttctaattttcgtatagaagcttctatttttttctgatttttcgacgctataacctctttacattgcccagtcgtaagaattccttttatctcactttccggagcattatatattgtagatggatgtccaaagtgttctagaagttttttctgtgtctttacaccaattcctgcaatattcgtaaaccaataccagtaaaaatcattgttcgtcatctcaccttaaccctcccttctcccttttgtctaaaatatagtgcttcctctacatgacggctttttatatcgtaactaccttctaaatctgcgatggttcttgccacttttaaaatcttaaaataagaacgccctgtaagctggaaaacagaaaaagcttctttcataagctgctgtccttcttcatctagtttgcaatagatttccacctcattcttattcattctgccattaaacaatgtagtactttgtgcaaaacgttctttttgtatctcccatgctttgcttacccttttccgaatatccgcagaactttcttctttagagttcgaagtcagcgcttcgtatcctatctcctcacaacgaacaaacaaatcaattcggtcaagaatcgggccacttattctattctggtactttacaatctgacgataggtacagcggcatttatccattggataatatccgcatgggcaggagttcgcacaaacagacagcaaaaagtctgccggaaatgtcagggtttgttcctttcttacaatagaaatctcatgtttttccaaaggaactcgaagcatttctataatttctcttttatattctggaaactcatctaaaaaaagaattccatgatgtgcaagagaaatctctcccggctgcggagtcattcctcctccaaacattcctgcctgtgtaaccgcaagagagggattacggaagggtcgtttcgtaatcaatgaaaaactgtcttttaacaagccttttgcactgtatataatcgtagtatctatcatctcttctgttgtcatctgtggcataattccagaaatacaggatgctaacatagactttcccactcccggcggaccacccaacattaaattatgatatcctgccgccgcaatctccattgctcttttagccataacctgtccttttacttcagaaaaatccgtaacagatattttgtcttcgtctgcattttctaaaatatcttttacaagtaaatttaaacttcgtgtactttccgatatctcctgtgattttttgacatcttgtatcgtacattcctttcctgaatcttctgatatattccctgaattctctaatatttctcctgagtcatcatttataatatacccatgttttagatagaaaaaaagttcttctaaattcctacatccaactacctccatctgctctacaaaagcagcctctgccacgttctcctgtgccacaatacatctctttattcctcttttagatgcagcaacgacaatcggtaaaacaccagaaatcggacaaatctgcccatttaacgatagctcaccaacaaaaagtgtatcttttatataagtttccgggacaaaatccattgcaagcaaaatcgctgccgcaaccccaatatcaaaagaagtcccacattttcgaaaatctgccggagcaaaattcacagaaatcctcttcggcggcaacaaaacaccgatattattcaaagcagtacgtacccgctcttttgactccttcacttcattagacaagtatccaatcatattaaaatttggaagcccattactaatatctacctgtatctttacaatctgtccttcgattccctgtatcattgcgctaaaaacttctgctaccattgtctctgctccttcaacctgttataataatgtcaaattttgtaattaattcctttatatcacatatttctaaaatatgcaatatttattttagatttcatatttttattataaatactataaatgagcaaatacagaaaaaatgcacaaaaataagtgcttcttgtttgtagtctaaacatattcagactaatcaagcaatgtatgtctttataatgcggacatagttgtgcaatattttaaatttactcatttatagataaatagtaattttgtccactgtcaaagtcagcccactggaaaataaataaagcatatttgtggcctcgaagcaaggtttggatgcgaacatccaaaccttgcttcgaggccacaaatatgctttatttattttccagtgggcgtctgtttagccacacaagttattatttaacggttattatccaacatcttcttgagttcattcataaatgtttccacatccttaaactcacggtaaacagaagcaaatctcacatacgcaacttgctctaaggacttcaaatgctccatgaccacctcgccaatctgcttactttcaatttctttatattccaaattaaaaagttcattctctatcttattcaccatctgttcaatctgctctacagataccggacgtttatgacaggcgcgcaaaattccggacatcatcttagaacgatcatatggttctcttgttttatctttttttatgacagtgagtggcataatctctactctctcatatgtagtaaatctttttccacattcgtcacaaagtcttcgccgtcgtatggatgaattatcatctgcaggtcttgaatcaattacacgggtgttatccaatccacaaaaagggcatttcatatcttatcctccagtatttctatctcttatgtttacatttatcgtgccggttattataccagaaaaatagctattttacaagacatttcttctcgtcaatatctacaaggatactatctacgcctattcgaatgactgctccgaccggaattttatattctgattttttgccaagacaaccgcaatattttcctcctgtaggaacatagaaatctgtgatacataatttacatacatcaatttctaaatctccaacacagcctaagcgatgtccattcttacaattaatcacatctttattactaagttcccaaaaacgcatcaaaaaagccctttcttttaaattatgagggctttcttaaaataatgctatctatatgctattcatttattatctagagggtgtttgaaaaacacgctctaggagcaaaatattgtgaccgtaatggaattataagttctttttattataaatttctttattgcagttcatattcctcattcatatgcaatttcatccactgaagcatatctgtatatacttcatctcttcgcacttcatcacaaatattatgacgcatcccttcatataaatgcagctccacccaatgacgagtgtcttctaactgccggtgtacttccaatatcccctttccgccattaccaataggatcctcttttccgccaagcaacaaaatcggtatatcttcatttacggaacgataccatttcctggtggagactaatgcaagcatttttaaaatatcttcatatgctgctacggtaacaggaagatgttcagaataaatcctggaatattctcgtcttattttttcattcgcagcaatccaggaatatgtgtcctgttcctttaaaaaacgatgatttaaacgtttttctatatctttttcaagatatacacttctgtgttccgcccccaaatcctcttcaaaagggccgctaaaagaatctttctccaacaatacttttgtttaccgctagtccccgacaaaatcactccattaatgcctttttcatggatacaatccattcgcacaatgagagatcccagtccgtgtccatagataaaatacggtgtatctggatattctcttttcatatagtgtgtcagcttttttgtattttttaccagataagtccatccattcttgctgccaaaatagccatagtcctcttttttagaagaacgtccatgcccgatatggtcacatccgcaaaccataacgccatgatctgtaaaaaaacgaatcaaattctcatttctctccacaaaatctccaaaatcatgcacaatctgtaaaatagcacgaagatctgtctccggttcatagatataataatgtattctgtttatatgatcagaactttgatatgttcctgtaaatttctgataagccatacaaaagcctcccgtcctctctgtatatgacagattccttttctcaactactatacaggataaatgtgaaaaaagaaagacaatctgtcttgcattttcgttaagatagattgccttttctttcgtttttattaagtttcttacaataaactatattccagaatatggctgaaaaattactatagcaacctatatttcataacttgcaacaagtattttcaaagacatatgagaagaagaaaaaatcttctccgcaaattcaagaatgccggggcattcttgaatatagcatcaactaaatcatacagattaaagaataatcttagcaggacacttctctgcgcactttccacatccggtacatttgctgtaatcaatttttgcgatgttgttctcaacagtgattgcatctgcttcacagacacgagtacacatcttacaaccgatacatcctgcggagcatacttcttttactgctttaccaaattctttggagctgcattgtactttatgaggagctgcatatggaacaagctcgattaaagatttcggacaagttgccacacatttaccgcaggcaacacatttttctttatcaactacagcaacgccattgataacgtgaatagcatcaaagtcacaaacctttacacagcttccaaaaccagtacagccaaagctgcaggcttttggtccaccgccaggtacactcatggcagaaacacagtcttcattaccagcatatttgtattttgattttgccttatcgcaggttccggcacattttacgaatgcaacctgtttttcgcctactccagcttctacacccatgatagaagcgattttatctgctactggctgtccacctacaggacatgctccaactggagcttctccagcagcgattgctttagcaagtgcatcacaaccggcaaatccacaaccaccacagttgtttcccggaaggcactctcttacagcaacttctttttcgtctaccggcactttaaatttctcggaagcaatgccaaggagaatggaaataacaagtccggttccaccgacaactactgccgcaaggataattccacttatactcatttttgtccctcctaattaaatgattcctgaaaaaccaaagaatgcaatagacataagtccggctgttaccattacgataggcataccctgccaggactctggaatgtcgttgtattccattttctcacggattccggcaaggataacaatcgcgattgtaaatccaatagaaataccgagaccataaactacagactgtaaaatattatatccatactgtacagagtttaaagctacaccaagtacggcacagtttgttgtaatcagtggaagatatactcctaatgattcatacaaagctggcatagatttctttaagaacatctctacgaactgtacaagcgcagcgataacgaggatgaatacaatcgtctgtaaataagttaaatcaagtggtgcaagaataaacttgtaaattaatgatgtcactaaagaagcaattgtaataacgaagattacggctgctcccattccaccggcagtctctacctttttggatactccgaggaaaggacataatcctaaaaactgactcagtactacattgttaacaatagcggcactgataattaataatattaattctttcataatccttcccctttctatttattctctgctttttcttcagaagcagcctttgtttcttcttttttattgtctacagacatatcaaagaaactcttgctcgaacagcaggaattaccgcaggcagagcaatcgccacatcctgcaggaatctcttccatctcgccattctttaccttacggttcataatcttatttcttgcagctactaagcaggcaagtacaaagaaagcaccaggagcaagaataaaaatagtaattggtgtgtagaaagattcagataagattgtctttccaaaaattgttccggcaccaagtaactcacggaacgcacctaaaatagtaagggatactgtaaatccaagacccattccaagtccatcaaagaaagaagaaacaggaccatttttacttgcataggattctgcacgtcctaaaataatacagttaactacgattaatgggatatatacaccaagagcatcatttaatgctggcacataaccctgtaagaggaactgtactactgtaactaaggatgcgataattacaatgtatccaggaatacgaactctatccggaataaaattacgcagaatagaaataatcatattggagaacattaatactacggttgtagaaagtcccatacctgcaccattgattgccgatgttgttaccgcaagagtaggacacatacccaagataagaactaaggtagggttttctttgataataccattataaagtctttctaaagcactattatttttcatcttagttacctccttctaatgactggaaataagcaagacagctattcatagcacctgtaactgctttacttgtgattgttgcaccggaaatggcatcaatctttgcgtcatctccagaaccggaaccatcttttacaacagagaaagcatctgctttcttaccggcaaactgtttgccccagcttgggtcatctttggctttcataccaagacctgctgtctcactgatagagagtacggaatatccgcttactgttccgtcagactgaataccaacagtaagctgaatgtctccaccgtatcctttagaagttgtgatattgaaaatgtaaccgagtgctttgccagaagcatctactgcctctactgcagaagagataacatcgctctcatgtccatcaacagtattcttataagaagcaatcactttagaagctgcttcctcggagaatccgtcaacatctttgaaatcacttgcctttggaaatacagccttgtatgcttccatctgtgcctttgcttcctgatcagcaataggtttctttgtgattccgtatactgcaccaaggacaagacctgcaacaacagtaataataacaagctttaaagcatcttttactaaagaattcattatttcttacctccttttccaaatgcggtaggagttgtaactctttcaattaatggtactaacaggttacagaagataatcgcataggaaactccctctgcggaaccaccgaataaacggaagattcctgtcaggataccaagtaagataccaaatacaatctgtccctttggtgtaattggagatgtaacgtaatctgtagccatgaagaatgcaccaagcattaatccaccaccacataactgttctgcaagatatgccatatcaaatccatgtccaccgaaaaggagaacaaaaagaccaagtgtaacaatataacatactggaattctccagctaatgattttctttgcaattaaatatacaccaccgacaagcagtaagagtgcagatgtctcaccaattgtaccagcagtattaccaaggaacatagcctttaagtttacgacttctcctgcttttaatgcagcaagaggtgtggcacttgttgtcgcgtcaaaacttccaccaaatccattataggagaagttggtcataattcctgcaaaagaaattaataagaagcaacgtgctccaagcgcagggttcataaagttctggcctaaaccaccaaaaagctgttttacaacgatgattgcgaataaaccaccgataacaggaatccagaatggtacttctggcggaaggtttaatgctaataataaaccagtaagtgctgcactgcagtctttaattgtaatcttctggtgcatgaagcgctgccatacatattctgcaagaacacagacagcaacacagattactgtattgatgattgcctttactccgaagttccagaaaccaaataatgttgctggaagaagagcaataattacgtcaagcataatgctatgtgtagaagccttatcccttacatgaggattggctgatacgttatataattgttcgttcattttttcacctctccttatgtttatttcttctttctgcgaagagccatcgcctcacgacgacctgtcttcatagactgggttaatcttctctttgccggacagatgtaagaacagcatccacattccacacattcacatccattgagttcatcaaataatgcgaaatctccgtggtctgcgatttcggaaagctttgtaggcatcaggccggcaggacatacggaaatacaacgtccgcaacggatacagttacttggctcacaagcagccacttcatcttttgtgaaacataaaagagaagagaatgtctttgcacaaggaacatctaatgtagataaagccatacccatcataggcccaccagagattactttttctggctgagacttaaatccgcctgctgcttctactaattctgcggcatttgttccgttctttactttaaagtttccaggatttttaatcgcatctcctgttacagttactactctctcaaagaggggttttccaagtgtaattgcctcatgaatcgcaatcgcagttgccacgttatctacaatacatccggcatcggctggaagcatggaagaattgatggcacgacctgttactgcaaatattaaagaacgctctgcaccctgtggatactttgtctttaatgcagccacttcaatacggctctcatttttacacatttctgtcaactttgcaatcgcctctggcttattatcttcgattccgattacacccttagctttagggaataaggaaagcataatattaagaccagaaataagctgttccggaatctccatcatacaacgataatcggcagtgatgtatggctcacattctgctgcgttgataataattgtatcaattttttccggttcctttggggaaagctttacatgcgtagggaatccggcaccaccgagtccgacgatacctgcttcttttactgcattgatgattgcttcatttgtcttttctgttactggttggaaggaaacagtttcgtactctccgtcattctctacaataatggagttcactttgttaccagaaactgtcattcttggttcaatcttttttaccgttccagaaacagagctatagatgttggcagaaacaaatcctccagcctccgcgattttctgaccgactaaaactctgtcacctttctttacacaggcaacggcaggagcaccaatgtgctgacttaaagggtataccagctctccctgtggtaaatattcagtaattggtttgtccttacttaactctttaccatcatacggatgaaggccacctttaaatgttagtagtcccatttttttaccttctttctaaaattttttaaatcaaatagtgcatgcatatttttgtaagtctcacataaattcttacgaaagcatttcaatatttgatataaaatcattaataataatataagaaaaaaagggcgaaatcaagaatcgtcattttcttaacgattagcaacttcgccatttcccatattttatataaaaaaacttcgctattatgcaattatttgcaatttttttgtgtagttttacaatactgtatttaaaatagaacaatattgtatgcaatccaatctattattgttaaataataaattatatcaactgatgttatttactgataatatctatctgattcccatcctgtgttccattctcatcaacgacttctacaaccactttatgaggaagacagacaatggtctctccctttttactaatcgctgcatgattgacacaaatcttatctggacagtctgcttttgccatactggctttcccatcctttatgataagaatattttcccagtcatcttcgccgattgtaacagtctggtttttatctaaagagtatattccatattccttattattaacactgacttttacctctgctcctctctttccctgaagctgcataaaagcaaaggcaccaataccaataatcagaaaaaacagaatcagcaaaatatcatttttataagacttcttagttgaatccaatccatttctgtgcaatcttatatcctcccatcgtgagtttatgactcagcttattgtgggacttagtaaactttccaagaacagagctttttaatattttataagcatctggagatttctcttcaagataatgccataaatcatctcgcatcgcctctgattctgatgtattcatcttcataagaagcacagaggttaccatctgaatcgtctcaagataatgaagcatatattctttaagctgtggacaggaaagcatgctctcatgctttgcataaaggtcaatcataatcttattcacacgaatctgctggtcaattcttgaaatcattaccttttcattgacagactggtcatcacgcccaataaaataccgataaaaatctacgtcaagataatacatcttcttaacgtatggcaatggccagtatacaaaaatgttatctacataaaatgtgtgttttggtaattcaaactgaaaactccgaagcagctctgtacggtaaatcaccgaatgcatcaaaatattctggctggcatggaaatgtccaatctcttcccatccaaagtaacgattctccggcagaatagaatgatactggataacctttttatgctttgctccaaccttctcgtaaacatagtttgaaagcagcatgtcaagaggctcttcttctttcactgcctcttttaaaaaggcaagtatcttctggtaagcttctgcgtctacccagtcatcactgtctactactttataaaagaatccggttgcattacggagtccggcattcactgcctctccatgtccaccgttttcctgatgaatcgcacgaataatacccggatatttcgcctcatattcatctgcgattgcaggagtctcatcttttgaaccatcatcaacaatcaatatctctacatcttccccacctggaagaagactttcaatacagtttctcatataatccatagaattgtaacttggaattgcaattgtcaggattttcatgaattacctcctttggtatcctatatacttttagaatctttctgttcctgctttagtacgaaaaattctcccagtcaaaaagcaaacctagagcgtgtttgggaaatcattcctgcaatctgcacatcttacagaaaacatttttcaaacacactctagaaagattcctaagagtatatttatttaattatttctcaaatccgcggtagatgatatcatctcttcccggaccgttagaaaccatagtaataggatatccaatatgttcttctacaaactcgatatatttacggcagttctctggtaaatcttcgtacttcttaattccacgaatgtcacatttccatcctggaagtacttctaatacaggttttgccttctctaactgatttgttacagggaattctgttgtcaccttaccatcaatttcgtagcctgtacatacaggaatctcgtcaaggtatccaagtacatctactacagtgaaagcaacatctgttgttccctgaagacggcatccgtatttagatgcaacacaatcaaaccaacccattcttcttggacgtcctgttgttgctccaaattctccgccgtcaccaccgcggacacgaagttcctgtgcctcatcaccgaagatttcacttacaaatgctccagcacctactgcactactgtatgccttacatactgtaacaactttcttaatctcatatggaggaatacctgctccgatcgcaccatatgctgctaatgtagaagaagatgttaccattggataaattccgtgatctggatcctttaatgttcctaactgaccctctaataaaatatttttaccttctttgattgccttatctaagtacgcagatacgttacatacataaggagcaaccatctctttgtattccattaatgtgttatacagttcgtctgcatcaattaatggtttgtgataaagatgctctaataagatatttttctgtacgataacacgctcaatcttttctcgaagtactgcctcttcttcaaataattcattaacctggaaaccaaccttcgcatacttatcagaatagaaaggtgcgataccagacttagtagaaccaaaagatttacctgccagacgctcctcttcatattcatcaaaaagaatatgataaggcataacaatctgtgcacgatcagaaattaaaatctttggtgcaggaacccccttagaagttatctcttttaactcattaaaaagaataggaatattcagtgctactccgttaccgataatacttgttgtatgtccatagaaaatacctgatggtaatgtatggagtgcaaactttccataatcatttataattgtatggcctgcattggcaccaccctgaaaacggataataatatcagaatcctgtgcgagcatatcagtaatcttacccttaccttcatctccccagtttgcgcctacgattgcttttaccattagctcattcctcccagctttaaaaacttactatttttatggatgtggtttgtcccatcacccaaacacactaattataacttactttgctttataagtaaagaataattacaataacttacttttctttgccattctgacaagcatatttcctttcgggaagttacgaagttctgcctctgtaattccctttaacttaagtaccagaacgaaatatacgataaccgcaaagcctactgaaatcatcaagcatataaatacaagaattcttaaatgaataaaacttccgaatattcctgataagatcaagtagattccctgataaaatacatagcagagtattcccataattacagaagaaagtaatggaatcataaatgttcgtttcatttcctgatgatatcctaaatacttgcgtacactcaaattattcagcagacacataaggaaagcatagaacatcgtagcaaatacaagcgcatataaattcaggtttgtaaaatacaacaacggtgtaagcagaacaacatgaaggacaagggaaaccgctgcgttacgaagcggaatatttacctttccaattccctgcaatactccattacttactgtagacagtgcataaaatataatactgatgcagccagtgcgtaaaatacttactgccagatcaatcgttgctttttgtgggaacagcacttccataattggataggcaagcgcccccattccaattgcagcaggaatactaataaccattgtaaaatgaattgcctgccttacatgccccctgcattttttatagtctttcaactcataactgccggaaattgcaggaatcatagcagtagacatagaatttgcaagcgcgatcggcacgttgatgagcacccagtattttccggagaacacgccatataaagaggccgctgtttcagaagccattcttttaaatcccataatatccataaataaagtctggtcaactaccgtactgatattgtagacaaacgtgcttaaaattaccggtgttaccatcataaagataatcctaaagatatctttataggaactgtcaacacccgtatcatctttttgaatttcttttttaaaatattttttattacaggagtaaataaacaacataaataagagaccggttataacacctgccccaatacctgcggcacttcccatcgcaccaaatactggaatcttatcggcatccccacctgcaaatgcatgaataaagaatacggcagccccgatactaatgactgcgttagccacctgctctacaatctgagaaagcgaagtcggaatcatcgtcctgtgtgcctgaaaatatccacggaatacccctaaaaatccggagaaaaagatagttggagctaaaatacgaagtacaggaatcgccttaggctgattcgaaggaattaatacagaggctccaaaaaaagtaataaggctggcaatcccacctattaccagaacatatataagtgcacatttaaataccttatgtgcaatcttatactgatgtaccgccatcttggccgaaaccaccttggaaactgccataggaatactataggaagatatcaataatatcatcgtataaatattcacagcaatactataatatccattaccttcatcacctataatacttgtaaccggacttcgatataatacaccgataatccttgtcacgatacctgccaccatcaatattgaagcctgggcaagtacattcgtttcttttgtatctttgctactcaactgacaaccacctttccaaactttaagggttattctttctcctgtttttataaattacataacttaagggttatcgttgccgataacccttagtattatacggatttctttctagcatgtcaatccgaagtttctgtatttttatacattaatctctgccttcattccaagaatgtctttattctcgtcaagaacaggctgaacgtattctgtaatgaactctactgtctgctctggagatcttccaacaaagttttctggtttcatgatggcctgaagctgttccattgtcattccaaatgctgaatctgctgcgattctttcaagaagatcattctctttaccttcttcttttacaacacgacctgctgccatagagtgctgacgaattctttcgtgaagttcctgacggtctccaccagcttttactgcatccatcatgatattttctgttgccataaatggaagttctctcataagatgtgcttcaattacctttggatatactacaagaccatctacgacattcagatataagtcaaggataccatcaatcgcaagaaaaccttctggtacagaaaggcgcttgttagcagagtcatctaatgttctctcaaaccactgtgtagatgctacgaatgccggattcatcgcatcagacattacataatctgctaaagaggcaattctctcacttctcataggatttctcttataagccattgcagaggaaccaatctgatgtttctcgaatggttcttcaatttcttttaaatgctgtaaaagacgaatatcattagagaatttatgagcagactgtgcaattccagaaagtacattaagtacacggctgtcaatcttacgggaatatgtctgtccggaaactggataacatgcatcaaatcccatcttctctgcaatctttccatcaatcttacggattgtctcatgatctccgttgaataactctaagaaacttgcctgagttcccgttgttcctttagagcctaacaacttcattgtgctgataacatattctaagtcttctaaatcaagcataagatcatgtaaccataatgtagctctctttccaacggtcgttggctgcgctggctggaaatgtgtgaaagccagtgtagggaggtctttgtacttcatagcaaatgcagaaagctctgcaatgacattaatcagcttgcttcttactaacttgagagcctctgtcataatgataatatctgtattatcacctacatagcaggatgttgctccaagatggatgattccctttgcatttggacactgtacaccatatgcatatacatgggacataacatcgtgacgtacttctttctctcttgcttttgccacatcaaaattaatgtcatcggcatgggcctttaactcctcaatctgttcctttgtcacactgtcaagacctaactcatattctgtctctgctaatgcgatccaaagctttctccatgtcttaaacttcttgtctggagaaaagatatactgcatctctttacttgcatatctttctgagagagggctctgatatttgtcgtacattgtttatacctgctactaaaaacatatacaaatgtgtatatgccagatgatttgcatctaaatagcttttcctttcctgattttttataattgccacttgattttctattagttaatttatccctgttctccacggatatcctgtgttggcggttcaatcggatagttaccgctgaaacatgcatcacagtatggaagtccgttgttaagttcttttaaacgttccattccaagataagctaatgtatctgcctcaatgctgtcacgaatctcatctaaagtcttaccataggcaatcaactgatcttcggaaggaatatccgttccaaaataacaagggtgtaaaaatggaggagaactgattcttacatgaacttcttttgctccggcatcctttaacatacgaacaatacgatgacaagttgttcctcgaacgatagaatcgtcaatcataacaattctcttaccctttacagcatcttttaatacattaagctttacctgtacactgctctcacgcatgctctgctttggcttgataaacgttcttccaacataagaatttttaatgaaagctgttccgtaaggaataccagattccatagcatatccctgtgctgccggattacctgattcaggaacaccaacaaccatatctgcttctaccggtgaatccatagcaaggaatcttcctgccttaatacggctggcataaacaccaaccccgtcaatgactgcatccggtcttgcaaaatagatatattcaaaaatacatcttgcctgcttagaagaatctttgaagcaaagttccctatttgatacaattccactcggtgttagggtaacaacttctcctggttctacatctcttacaaattctgcccctactgtatctaaggcacacgtctcagatgtaaggaaatatgtattgtctctcttgccgatacaaagaggtctgaaaccaaatggatctcttgccccaatcagctttctcggactcattacgataagagaataggctccctttaacttacgcattgctgcaagtaccgcttcttctgctgttgcggaagaaattctctctttggcaacatggtaagcgattacctcagaatcaatcgttgtctggaaaatagcgcctgtcttttcaagttcctcgcgaagttctaatgcatttaccagattaccattatgtgcaagagccagcgtacctttataataattcagtactaacggctgtgcattctctctggtactagaacctgcagttgaataccggacatgacccacactgatatttccctttaatttctcaaggttttcactgctaaacacttcgttgacaaggcccattcctttatgaacctgaatgttctttttcgggccgttggtatccgaaactgcaataccacagctttcctgtcctctgtgctgcagagcaaacaacccataatacactgttgaagcaatgtcatttccgtcgaaatcatatgctccaaacactccgcattcttcgtgaattccagaatccacacactcttcagaaaactgttcttccatatcaaacgccattttcttcctccataatttcattagtgaatataattgaaacgattgtatactaacataaaataagtgtccgtacaagccatttctcagatttcagaaccattcacaaattttatgtgtattttatatagtattttttatgaattttacagattattttcctgcattatgacgaaatagtttcgaatctgttggaaggattcctctgcggatttttacggaaagaatccggcttaccgcctcattaatcttactctcagaaatcgtgccgtctttcactgcttctaatacaccttcaaatgcctgttcaaaattatccggcattaaaatcatgtcatttccagcctgaactgccattaccgccgcctgatctgcgtcatagaactttgtgataactttcatattcatagcatctgtaataataacattattaaattgtaattcttctcttaaaatatctgttaccataagttttgtaagagaagccggggtttcctttcctgttacctggctcacagcaacatgggacatcattaccatatccgctcccgctgcaattccagattcaaacggaaggaattctacttcacggaggcggtcaattgttgcatttagatctacataccctttgtgtgtatcctctccacactgtccctgtcctggaaaatgcttcaaagtagaacttacgccctgagactgcaggcctttcacttcctgagataccattcctgctacggttttggcatcagaactaaaacttctatttccgatttccgtattttctgcatttgtattcacgtctgctaccggtgcaaagtcaaggttaaatccaagttccctgatttcttttccgattgtctctcctacttcgcaggcttttttactgtccccactcttaccaatctcggacatggcagggaacttagttgtctgcatattttttgagtttgcaattcttgctacggagccgccttcctcatcaaccgaaataaacaatggaatatcattacttttctgaatgtcagcaatcatactttttacctgctcacggtctttaagattataggaaaaaaagataacaccaccaggtttatactcttctaatttctgctgcatcttctttgttacttctgtctccgcatcaaaatcaagtgaatcggtacagacaatgaacatctgccctattttttcttttaaggtcatacttgaaagagcatcagaaaccatcccctctaaagtaatatcatctaattctcctgaatcctttgaggtagatgtactttcttcggatttttctttctttttatgggagccgcaccctgcaagtattcccgcaaacagggtaaagcataataataacactattactttatatcttttcattactcctcctgcggtgaaaaccgagggtcaaaggttctctttttgggtactttcttttttgattcatttgctgcagcaatcgcttcctcgcaaaaagtcttctgtgcctcaattgcctcttttccccttctgtccactttctgatatgtgccatcttctaaaagcctgtgcgcttttaatgtgtcactaagctgaacatctaaaatatgttttgctttttcttttaattcttcctcttcaactgggaaaacaatctctacacggcggtcaagatttctaggcatccagtccgcacttcccatataaatttcttcatgtccgtcattatagaaatagaaaattcttgcatgctctaagaaagttcccacaatagaacgtacccggatattttcactgactcccggtttgcccgctacaagacagcagattccacgaacaatcaaatcaacctgtacacctgcacaggaagcttcgtataaggcaaggataatctttctatcacaaagagaattgcatttggcgataatttttgccggtttgccttcttttgcgtttttcgtctctctgtgaatcatctcaagaaaacgctttttcatccagattggtgctacaataagacggttccagtttgccggttcggaataaccacttaacatattaaatacggctgtagcatcttctccgacaacatcgcggcaggtaaacataccggtatctgtgtaaagctttgcagtggaatcattatagtttcctgttccaagatgcacatagcggcggataccatccgcttctttccgcactaccagtgcaatcttacagtgtgttttcagaccaactaaaccataaataacgtgacagcctgccttttctaactttcttgcccagttaatgttattctcctcatcaaatcgtgcctttaactctaccaatacagttacctgcttcccattttctgctgcctgtgccaatgcagcgataatcggggaatgcccactgacacggtaaagagtctgcttgatcgcaagcacgtctttatcttctgccgcctgcctgataaatgccacaatcgggtcgaagctttcatatggatgatgcagtaacacatcgccctttcggatctgggtaaatatatttttatctgcacgaagctttttatttttctgcggagtatatggttcttcttttaaatcagagaacccttcaatgccataacatttcataaggaacgtaaggtcaagcgggccattgaaagcatacatgtcgcatggatgcactttaaactgcttctttaaatacttcaccagacggctatccatccgctcttcatactcaaacttgatgacttcgccccactgacgcatttttaaagacttttcaatttcttttaataaatcttctgcatcatcttcatcaatagataaatctgcatttctcataatacggtatggagccgaacagataatctcatgatttaaaaacaaaacatctaagtaatgttcaatgacattctcaagaagaataacacggcattttctttttcctccatccttttgcggaagcacaatcactcttggaagtacagaaggtacctgtactgtcgcaatatcgtagtctttcttttcttttttatcttcgccccggctttttatcaaagcagcaatattcaatgtcttattctgaatcagcggaaacggtcttgaagaatcaatcgccatcggagtcagtaccggatatacatttttatggaaatattcttctaaaaactcctcttctttttcagaaagactgttaaaagttacaatttctaaccccgcttcagaaagtttaggaagaagagaacgattataggtcgtatactgtttttcacaaaatgcatgggttttctcatttaatgcaccaagttgttcctgcggggtcattcctgcaatatccttcttcttataccctgcattgaccatatcttttaaagaagcgatacgcaccataaaaaattcatctaaattcgaggcagtgatacttaaaaacttcattcgctcaaataatggatttttgcggtctcttgcctctccaagaattctctggttaaactctaaccagctcaattcacggtttgtaaaattctccggtctgtcaaatatacttttgtccatcttctatcctcccctacaatgctcttttttgctttaatactggtgtgattccagtaaattcactaaaggtttctgctttcttggaaaagcgggtaatctctaatgtaatatcctgatttgtttcaagggaaataatcaattcctttccttttcttgccatagaacatttctcaagtttttgtttatgtcctctgtctaatgcatttgcaagccttagaatagaagataacttggcaatccgaagatattcttctctccagaatgcagtatctaactcgtcagtatctggaagttcctgtgtattgtaaagcacaatattagcaacttcctctctctctctgtgagataagcccataatctcagtggacatgattaactggtagccattcttacctggatcatttaagttaacatattttccaatatcatgaagaatcgcagatatttcaagaataaggcggtcccgttgtgtaagtccgtggaactttttcgtcttatcgaaaatctctaacgctaaatctgtaatatattgtgcatgtactttactataacggtatctttttccgatatactttgcagaagctacaatatcctgataaaaatcatggcttagttttatcttctttgtttcctgtgcgtaatccaccacgcttccatcacaaagattcgtcgcacatatataaacggtatctgctttagaacgttctaagaatgtcttataaataagtaccgatggaagaaccattctggcatcctcaatggaaagtccgtattttaaggcaatatcctgataggatgcctttttaatctttttgtaaatgtataaaatctgctcatagctcatcgtatcggtaagatgcagttccggaatcaggcgattgatattttttatctcgtctccgatggcgattacatttttaatatctttatctttcagatagccacttttaaacatatcaaattcatactgaatatattcttctaatacagaaatataatcgagtacgttattctcaacagattctaaaaatcccctcacttttactgtaccgatatctaaattctgcgtcatataaagtgcctgtttatcaaacagggatacctgtacacttccggaaccaatatctaaaatggcagtatttttttcaatgattttattgaaatcaatatctaatacctgaattcccttatacataaggaaacgaagttccgaattgctgagcatgataacatccacacctgtgcgaattttaatctgattaagaaccgatacctgattctttgcattacgaatcgcacttgtcgcgtaacatcggaattctgttatcgcatattccctcatacgctgctgaaattccatcagtacattacagatttcttcaatttgcgcaaatgtaatctttcttgtaaaataggcctctttgccaagttcatactcataacgtatctcatccactgtacgaaatccctttccaccggaaatctcatacactttcatgagcatattttttgaaccgattacaattgccgcatacggacttattcccatcgctgcctcctttttgcctctggcacttctccggctttcttatttcttctgttcgtcagaaagataaaagaaagaattcactgtatgttttgtatcaataagattattatattgtaatatctgatactcttttaccatatcgctataaggcgattctaaagcagattcataatatttgcccttcttatcaaagcatcccattgccgtaagtacaggaagcttcttgcggagttttaataagaacttctggtatgggcttgtttctaagcctgcctcgttcatcacataggcacttaaatagttcgcactcattttatctatggttttctctttaatatcatagtttgcccagataataaatggtgttctgtatttgttcattaattcttcatttgtaagactgcctgcactctttccaaaaaggctgtcatagaagctgctctgtacagccggctgatgatcaccatacattacgatgattgtcggttcttttacttttgaaaaatactctacaagctgtttaaacgcatcatctgtcttctttacaagggaaagatactgctctgcctgctcatttttatgattatctgtaatctgtatatcattatggaaattggagtacgtcttatcaaatccaccgtgattctgcatcgtaacattgaaaagataaaatggttcatctttctcagtacggttttcgtataactcctctatcttcttaaaatcagattcatcagaaatatattttcgatacattgtcggattcttaaaatctgtctctgaataaaaatgatcaaatcccatataatcatacacctgcacacggttccagccggaagcaaggtaaggatgtaaagccagattgcctttatatccttgttcttttaacagataggtcatattaggaagtttgtcctttacaacctgtgtgtatgcaataataccattttgtaagaaggacatgctatttccagttaaatactcaaactcggagttacaagttcctgaaccgaagatagacatataaagagaaccttttattgtattctcctttaaactatgaataaatggcatataatcttcatttgtggaaaattcattgataacacttaaatcagaaaatgcctcgttcataatgccgattacatttggtttcgtaccatctgcagtttctaaccgcccttttttctttttatcggaatcttcattcgcaaacttttcttcatatttctcggcaatgtctttggccgcctctacagaataatcagatggtttttcctgcaccagagaattcatgttaagaacaaaaccaaagaacagtccattcttggcatagccttttttctgatcccacacgttattcttaatgccaaagttctttaatgttttttgttctacgacaaaatgtccgagcactgaacctagcaggccgataacaacaagcataattacccgctttttccagcccatttttttaggaaccggacagcgccacattatggctaaatataacagcaggaataagacattccatacaaataccggctgaatgctgtaagtatagttctctgcaacattcgcagctgttcttgcggacataatatctgaaggaacgatcggtgcacctttaaaacttaaaacataatagtttgcaattccaataatgcaccacaaaatacttcctattgttacagatactctcctggaattgaaaatcagatacaataatccaaagaacatataataaactaatatgttaagccaaaattctgcagcacgcattctaaaaattggattgtcagtaaacctttccacaaaccagaatgtaaataacggtgctgcaaaaaacagaatctgaccaagtgctttctttaccatctccggtgccggcagtgcaaaccataaaagaagaaggacaagtgccatcatcatacagatacctgcccactgctgatatattgttactggataatagagcttagatacaagatacttaccctgctcttcctgattaatctttaacttgccacggaaaccagtttcctttgttgtccactggaaaataagaggttccttgccggattctgctccacttgttgtaagctgaatgctgtactctttctttttcgtcagctgcagatctgtcttaaattctgtataatcattatttacaatatcactgatattttttgtaagtctctgtatgctttttccggtttctaaatctataatattaagaataacctttccacttgcctgtccagaatagtcattgccaaaataaacttttaccgtttttaaatgtgtatgttttgcaacaaacttctggcttacagcagatcctgccgataactggcagacctgatcaattcgatacttatttacctgatttgttgcatttttctgatattccataaagtgactgcataaataccaggtaaagaaaagaagaaccgctgtaatcactgtctttaataataaaaccgccgaatttttctttttcacatgcttattttttactgtttcactcatgtactctacgctccttttgtagaccgtttaatagtttcctaaaattttaaaatccgctacttctgtacgaacaccttgcagggcattttttactgccggatcatgcagatttccgttgatatcaatatagaagcggtattcccactgctggtctggcagaggaacagattcaatatggcttaagtttaagtcattatataagaaatgagataatatgttataaagagttccgctttcatgaagcagagagaaagaaatgctgatcttattcgcattctctgtgtactgtctcttcttagagaggattacaaaacgagttacattatttttgtcaaagttgatacctgcatctaaaatatcaagaccgtaaagttctgcagctctgcggcttgcaatggctccctgtgtcattattttctctcttgctactctctcagcagcaatggctgtattttccacactaacctttttgacatccaggttttctaaatatggagcacactgcattaatccctgcggatgtgaaagaacaacttctaaatcctcaatcttacttcccggacagcctagcagacaatgttctacttttacaaaaacttctcctaccatacagacatcattctccagtaaaatgtcataaacacctgtaacatctccggcagaagagttctcaatcggaagtacgccgtaatcggcatctccgttattcaatgccatcgcaacatctttaaagttaacaacggcataatgatctacatccgctccaaagaacttttcacatgccatctctgaaaaagatcctggcactcccggataaacaattcttgtatctgggaacatgactaactctggtacttcggtaaaataattctcaatatagcggtctctctggtgaaccatatgatactgatatttgcggcttatggacatcatctgaataaaaacttcctctaatccctttatgacaaatggattggatcggttctttgtaatatctgataacttttcgtcttctttatttttattataaatggattctcccgcctgctttttagaaagcgctaattctgcggcaaatcccatccttttttcaaataactctgcaatttcgtaatctatttttgtaatatcatctcgtacatcatctacttttcttatttctttatccattccactactgcttcctttatttctctttttcttttaaatcctctaaaatatctgaatatcttcttctctctaacggatggattcctcttggagtcaactcacacaatggctctaatacaaaaagcctttttgtcagttctggatgaggaatcgtaatctcctcatcttctgtcactaaatcatcatataaaagaatatccaaatctaatgttcttggtccccagtgaatctctctctttcgctctgcctcattttcaatctgatgtagtttgtcaagaaattctgctggtgtatctaatgtttcaatcgaatatactgtgtttaaaaacttgccctgctccgtataaccgtatggttctgtctcaataattgaagcagatttgaagttctttgtatccggcaaagcactcactttctcctttgcaagtttcatatattcttcccgctctccaagattagaaccaacaccaatatatactttatgccagcttctcttaatcttaacagaagtgtaatccacatgcattaagacaggtgcccacggctttttcacttcaatctccacttcttttataagtggaaactgcaaaagaatacactctgcaaggcgttcggcaactcgttctaacagtttgtcgttctgctttgtcatttcttttttgacacagcggcagatatctccgtagcttactgacaattcaagttcatctgtctttcctgcagcccttgtgtctacttttgaaacaatattgacgagaaacttctgaccgagaacattttcctccttgtatacaccgtgatggcaaaatacttccagattctttactcttatctcatccatcttactctgcctccagaattgcctcaatcatcttcaattctctatagtttgtctttacatcgtgcacacggaaaatagaggcccctttcatacggccaagtactgttgttgccgcagttccttcctctcgctgatcaacaggaagatttaacgcaagaccaatcacagactttcttgatgttccaagtaacacaggaagtccccattttgaaaatacatccatatgcttcataatagaaaggttctgctcaaatgtttttccaaagccaacacctggatcaagaacaattctttcgtccctgattcctgcctttttcgcaatggccagtgtctcttccatatcagaacagaaatcctcaataaaattagtatactcctgattatctctgttgtgcatcagacaacaggcaacgtcctctttggcaagtaacggagccagtctctcatcccatttcaatccccagatatcgttaatcatatctgctccggcagcaattccagctttagaaacttcgtatttgtaagtatcaagagataccgcgatatcaaaattcttctttattgcttcaatgaccggaacaactctttcgatttcttcctggtctgtaatcttcttatggcctggtcttgtagattctccaccgatatctaaaattgctgcaccttcctctatcattctctccgcctgttttaacgccagatcaacagactgatatttgccgccatcggaaaaagaatcgggtgttacatttaaaattcccataatatagcctttatgtaaaaggtcaaactcgtattttcctatcttcattactgtatagcctccatttcttccataaaagagagcgaaccacaggccaccagaatatcttccggctgtgcagcctccaatgccttagaaaccgcagtatttacgtctggctcaatcataactggaacatccgctttctcttttattgtatttgctaaaatttctgctgaaagcccccgttcattattcggtctaaatacataaactttctttgccatcggcataagatactggagtattttcgtatattctttatcctttaacactcccattatataaatgattctcttatttgtaaaatgtttttgcaaaaatgacgctaatttgcgtgcgccatctggattatgtgcaccatctctgtaaaataaaggttctttttttaacacttcaagccttcccggccagattgtccttataataccaccttgctgtgccgcctttatgttcatggtatctagttcttttggaattttcttccttgcctcattcttctcataatctttctcaaaaagatattctgatgcggtaagggctgtcacagcgttagaaatctggtggtttcccggaagctttgtctcataacgctgttccttccataaaaaagtacttccatatggagtttccgctaatatctcataatcttgcggctttacttcgatgcaatgtacctttttctctgctgcttcgtgttttacaaccttgcagacttcttctggattctccgataaaacaacaggagcactctctttgataattcctgctttctggcaggcaatctcctctaacgtatctccaagaattgccttgtgatcatagctgatggaagaaattacagtaagttctggatgcttaatcacattcgtggcatcaagccttcctcccataccaacttccaccaaggcgtaatcaaccttttcctccttaaaatataagaaagaaagcgctgtctccacttcaaaaagtgtaggtcttaatccaattttcgcctcctcttttcgcatcgcttcttctacaacaccgtaaagcctctctaacttatcctttgcaatatacgttccattaatctggaatctttcctcatagcaggaaatagtcggggaaatatatcttcccaccttaaaacctgctgccattaatatagaagaaagatatgcaaaaacagaaccttttccgttcgttccggcaatatgtacaatcttcaaatcatcttctggatgccctaactcttccagcaacccctgaattgcatcaagacctggtatactgcccctcttttttaactcttctattaaagaaatgtaattcattactaacgctccttcatattattgcgtatacaatcgaggataataataacataaaatggggaagtgtacaactctttgcataaaacggacgaaaatcagccgctgatagttgagtaggtagctgttgctctattgcgataagccaaactgaatattgaagcaaaaacagaacaggagatatgaattgcaacatttgacgaacgagtcatgcttatgttcgtcttcagaagacaatgaagttgtctctctgaagacgaacataagcatggcaaagttcttcaatggttgtgattcatactcctgttctgtttttgcttcattcatattcctctgttgcaataaagcaacagtttcctactccaatcagcagtctaaaatgtatataagaactctctttttatcttaatctaaaactaaagcgacacccagtctgtctctctatcctatacttcgaagattaaatctccataacttgggaatggccatgcagatttggctactaacatttcaagtttatctgctggttttcttaactcatccattgctgtaaatacaacgtcatggtagtagtgaccctgttctgcgccttcttccatagcttctgccttgcctgctacttcttcgaggtgtgcaagtgctgcatacatatcttttaagtttgtagaaatgtctgccattaatgcttcctgtacagaagtatctactgcgctgcttgctgctttgattgcattaacagattctgcaaggctggtctggtatttgattgttgcagggacaatctgtttcttagccatgtcaatcatagtaagtgcttcaatgttgattgtcttagaatatgtttcgtacataacttctgcacgggattccatctcggcttttgtatatacaccgtgtttttcaaagatctcaactgcttctggttttactaatgcaggaacagcatctaccatacatttgatgtttggaagtcctcttctctctgcttcaacaacccattcatcagaatatccgttaccgttgaaaatgattctcttatgtgctgcgattgtatctttgatcatgtcatggagagccattggtaagtcctctgctgcctctagtttgtctgccatgtcacataatacttctgcaacgattgtgttaagtactgtgttagggtctgcgatagactgtgtggaaccaaccatacggaattcaaacttgttacctgtgaatgcgaatggtgatgttctgttacggtctgtagcatctttctggaaatgtggaagagaatgtacaccagaaatgtattcttctccctctaaggagcttgttgcttctccattatctacgaattgttctactacgtcctctaactgttctcctaaaaatacggagatgattgctggaggtgcttcgtttgctcctaaacggtggtcattacctggtgtggaagcagaaaggcgaagcaagtctgcatgttcatctactgcacgaagaattgcagctaagaataataagaactgcatattttcatgtggtgtttcacctggatctaaaaggttctctccctcatctgtacacatagaccagttgttatgtttaccagaaccgttgattcctgcgaatggtttctcatgtaagagacatttaagacctaactcatcagcaactctctgtgctgtttccattactaactggttgtggtctgtagcaatgttgttctggtcataaataggagcgatctcatgctgtgctggagcaacttcgttatgctgtgtcttagcagaaatgccaagtttccataactcttcattaaatttctccataaatccaagaactctttctgggataacaccgaagtaatgatcatccatttcctgtccttttggaggcattgcaccaaataatgttcttcctgtaaagattaaatcctttctctttaagaagtttcctttatcaacaaggaaatattcctgctctgctccaacagatgttgttacatgttttgctgtcttatttccaaataatcttaagatacgaattgcctgtacgtctaatgcctgcatagaacgaagaagcggagtcttcttatcaagtgcctcacctttgtaagagcagaatgctgtcggaatgcaaagaatagtagaatgtggtgtttctttgataaatgctggtgatgtgcaatcccatgctgtatatcctcttgcctcaaatgttgctcttaatccaccggatggaaaagaagaagcatctggctcacctttgattaactctttaccagagaagcgaagtaatgttgttccatcaccctgtgggtcaataaatgcatcatgcttttcagcagtgataccagttaatggctggaaccagtgagtgaaatgtgttgctcctttttcaagagcccattctttcatctcatgagcaacgatgtctgctacttcaggatcaagttctgcgcctgcttcaattgtagctttcatcttcttatatgcagcttttggaagtctttccttcattactgcgtcattaaaaacattggaaccaaaaattttcttcacatctgttttcataattattacatcctttcatgtttatccttttcatcgacaattgccattcctgcccgaaggtcaaaaaatgtaaaaagcgtccgagaatccttatgattcgcgaacgccattgttctcatcgagattgaattatttacttttcgcaattgctaaatataaaataccccgatttgtttaaaaatgcaagtgatttttgtgttttttctcactttcatgaaattagacaaaaataacttgagtttataaagcaaattcctatatttttaacaattagccttatttgcgcttaattttattaattcaatcgaaaatttctaacaaaaaaaccctcacaaaaaccgctggcaatatgttgttcgggcttttgcgggggctggcattcggttatcccgctgagtattttgtaaattttttactaataattgaatttctcagcaaagtaatccttcaaatcttcaattttaattctttcctgttccatggtatcacggtctcgtacagtaacagcaccatcttctacagaatcaaagtcatacgtaacacagtaaggagtaccaatctcgtcctgacggcggtatctcttaccgatatttcctctgtcatcaaattcgcagttataaatcttgcttaattcatgataaatcttctcagcaccctcattaagcttcttagaaagtggtaaaataccaactttaactggagcgattgctgggtggaaatgcatcacatttcttgtctcgccgtctttaatctcttcttcgtcgtatgcagcacataagaatgctaatgttacacggtctgcacctaatgatggctcgataacataagggatatactttttcttctctgcatcatcaaaataagtaagatcctgtccggatacttcctgatgacagttaaggtcataatctgtacggtcagcaataccccataattctccccatccaaatgggaataagaattcgatatcacttgttgctttagagtagaaagataactcttctttatcatgatcacgaattcttaattcttcgtcttttaatccaaggtcttttaaccagtttacacagaaatccttccagtatgcaaaccattctaagtctgtatctggcttacagaagaattctaattccatctgctcaaactctcttgtacggaaagtaaagttacctggtgtgatctcattacggaaagacttaccaatctgtccaataccaaacggaatcttcttacgggaagtacgggcaacattcttaaagttaacaaagataccctgtgctgtctctggtcttaaataaacagtattctttgcatcttctgtaacaccctggaaagtcttgaacatcaggttaaactgtctgatatctgtaaagttatgctttccacagcttggacatggcacattgttatcatcgataaatgccttcattttctcctgagaccatccatctacagaagattctaactcaatctcatgctcctgtgcaaaatcttcgataatcttatccgcacggaatctttccttacattctttacaatccattaatggatcagaaaaactgccaagatgaccggaagctacccatgtctgtgggttcatcagaatcgcacaatcaacacctacgttatatggactttcctgaatgaacttcttccaccatgctttctttacgttgttctttaattctacgccaagatttccatagtcccaagtattagccagaccgccataaatttcagagcctgggtatacaaaacctctcgcttttgcaactgcaataatcttgtccattgttttttccatgacacttttacctcatttttctttattcgatatattttcgccttttattctaccctgtcttttccaccattgcaagccctttttgtcagacagcaaaaagttcttcaaaaaaatgactgaattctcttcagaaaactcagtcattgaattaccgggtatctgctttgtgattcttcatatcgcagattgcaggaatgatttttcaaacacactctagcatttcagcagatttaaacctatgcccagcctgtactgcaaaataccgctttactatccactcaaattctttatcaatgttttctttgagagtaaaggaatataaacggtttagtggaatcgaagatacatactgcagtacataaagaactgccgattccacctctcttccctgtccttttacagcacagccgctgcagagcataccgccctcttcaaaagaaatccttgtaagatgctcctcgtttccgcagtgaacacattgaaaagactgcagcccaaatccggcaaactgcaatattttcagttcatagattctccgtatgagagaaagagaaatcagcttctttttcatggcaagaaaagtaacaaacaaaagattcagtatatttctttcgtcctgcccttccattgtaaaatattctgccacttctgcaaaataagaactataataaatatcttctaaatctttttttaagaaataaaaatagtctttacactccgcagaatttaagtatgtataattcctcgtatctgtgaccataaactcacaataaataagcggctgcgtcaccccaaacaaagggtgttttggccggcggcttcctctggcaaatacctgaatcttcccccgctcttttgtaagaatcgtaagccgtctgtcattctctccaacaggatagactgacaggacaatccctgtcacttttgtttgttcactcatcgttgtctttacagttctttcttattataaccatagtttttcagtaggatatcactatctctccaatcttttcgaacctttacccacagacgcagatttaccttcatatcaagaagattctccatctccactcttgcctgtgtaccgatttctttgatcatcgcacccttcttgccaatgataatacgtttatgtgactctctctcacagacaattactgcctcaatatctacaatattgccgttttttcgagtcttcatacgctcaatcacaacagcaatgccatgtggaatctcctgacttaacagacgaagcgccttttctctgacaagctctgccacaatctggcgttccggctggtctgtgatagtatcctcatcataatacattggtccttctggaagatatttaaaaatagaatgtactaaatcatctgtattattaccctctaatgcactaaccggaataatctctgcaaaattacactgatctttataggcaacaatggccttcaagatttcctcttcagttgcaacatctgtcttattgattacgaggaagatcggtgtctttacattctgaagcttctcaataatatactgctctcccccaccgataaatgtcgttggttctacgagccataaaataagatctacttcattgagtgttctctcggcagccataagcatgtaatctccaagcttattctttgctttattgattcccggtgtatcgaggaagacaatctgaccttcctcgcttgtatatacagtctgaatccgatttcttgttgtctgcgctttactggaagtaatcgcaatcttctgaccaattaactgattcattaatgtagactttcctacattcggacgaccaataatggttacaaatcctgatttaaaacatctgctcatattttttcctttctctattaccctctattgattcaggctgcatacctgcttaaatatctctttttcttcttctaacttacggtcattgccgatagcacataccgttcctgcgcccatcatagattcaatataatcggcaagggagcgaatcgtctcatccgttgcatcgagtacctgatttctctctttttgaatcatctctactgtaattcctgactggtaggcatggaaagaacgctctcccaatgcagacggctctaacggctgatcaatgccactgatagttccgatgatatactttgtcatatctctcttaccagcttcaaagtttctcacataatccgctgcctttttataaacatccaatgtagcagaaaggtttggatctctgtaggaagtaaaaaaaccatatccattccttgagaaattacacatacatccgtatgcaccgccagtcacacggacattcacccagagataatcataggagaaaatggtctttaatacctttaatgcaccgtggtattcctgtccttctttttcaaaacagccggcacttgctacatactgtactttacttgctgtcttaaatccctcattctttttctccaaaacaaatgcgggaactgctttaacgcatggcatatcataaagcatacggttaaactgtagcatttctccttccattaaggacttaaagttaaactctcccgtaagggataatgtcaggttctctttacggaaaatgcacatctgcgctctcacgagctgcttcataagaagatctgcattactgtcaaagttcttatcaagcttctttacaaattcataaaaaccaattccttctgctgtatctttgtatttcatcatcgggtcaatataagaaagggcacgattcgctgcatatacatgacccgctgccggaattcttgtatccatctttgtgcgaagttcagaaataatctcttttaaacgcttcttattatccatcttggagcttaaaagaacttcttttaacagggacatgccatctgccacctgattctccatacacttcatatgaacactaaaatatggacggtaggcatcctttttccatacaagaacgttcatgcctgtctgaaaagataatccaccaatctttaaattgatttctgttgccagatcattataggaaaaatgttctgtatctacataacgataaatctctgtcagtaaagtagcatatggaatcagttcttccggcagttctgacatatcaaagcaaaaatcagaatatacaattccattcgtatggtattcatgaacaactgctgttgtaccgccaattgttacctctttattcttaaatggaagtacctctcttgaaatatcactcaagtctaatgtaggaatcttctctaactcttcctgagtggaaggtgtctcctgaaattccttcaacttctttgtatcctcaatcagatagtttaactgttttgcgttgagcttatctttcattctggcaagctgctcttttaattcttcctccaagcgctcattcttgccaacttccggatagagatagacataggctttatgagtattctctaaaaagctttctttaataagctgttcaaaatagcctgtctctaccttttcttttaatctggcaagcggagtcagggaatcagcaagttctaatgcctttgtatcatcatataaccagctatttaagaaattcagtccataaataagccccttcggaaaacggccgaaatctgcttcgcgatacttaaactcataattattaatcgctgaataaatcgcctttttgttaagaccattttctgcctgctctcttaaggcttcttctaatgtttttataaaaagagcctcgttaccctttttcgcattctttacaataacagaaaacaatggctgctggattccgccatcatagtagctatccacatcttttccaagaccggcatcaatcagtttctttctaactggtgcacccggcatggtaaaaagaacataatcaagaatctgcattgcaaggccacgttcgttatcacagctatctcccgctgccacattataacttaaatagacaccttcctcttctttctcagacacagaataggtatcttttaatgtttctggtgctttgaacacttcctgcattgcaactttagaatccactgtctttttctcatagtggcttaaatattcttcgtcaataaaagcaagctctcttgcaaaatccacgtcaccatacaaataaatataactgtttgatggatgataatatttgctgtgaaactctaaaaacttctctctggtaagttccggaattgcatctgggtcaccaccggactcaaaagcatacggagtatcctttaagagtgcctcctgaatctttctagctaaaacatcatctggtgaagaaaaaacacctttcatctcattgtatacaacaccattaaacttcagttcatcatccttatcagcaatctcgtaatgccagccttcctgtttgagaatctcatctctcttgtaaatattcggatgaaaaacagcatctaaataaacgtgcatcagattatgataatcctgagcattgcagcttgcgattggataaactgtcttatctggataggtcattgcatttaaaaatgtattcagagaaccttttgcaagctcaataaatggatcttttgatggaaacttatccgaaccacataatacagaatgttccaaaatatgagcaacaccagtatcatctgccggaggggtacgaaatgcgatactaaataccttgttcgtatcatcattctctattaaaagaactctcgcaccagtcttcttatgttccaatacatagccgtatccattcagttcgtctatcttttccttctgcacaaaggaataacttttaaaatctgtttcttttagcattcgctatctacctcctgctttttgtattttataaaaaggactgtaaccgctacttttatcctgtcgtagcattccccgtttttaacagttttatttttgattacagatattgtaataatccagaacttcatccacactactctgaatcattacagactatttaatatcataacacaagtaaccgaaaaaaaaaagaaggtcttaccgaagtaaaaccttcttcctattcttataaaatattcagcaaatatgtatgcgatattctgactaattgttgatgttctacacacctatttatataaggaagaaacgtctattttccgtgtatatattcttcgattttcgcaaaaaataagctgtttttattatctgtatatttttttagtacctttttagtacttctcgtatggcggcaagtgcggaacttttcacgcttgtaacaagtgtacatctagtacggttgtacatgataatggatactccaaaacttaacaacctttatcaaaacttaagaatatgaaccagatattgaatttaatgaaaagcaatacaaggacgctttaaatctcttttggtttctccaagttctaaaagttcttctaatttctctatgaaacctttcatacgcacgcctactatacctattggggtattggtgcataatacccgtatgggtatatgttgtcaatgatgaaattacaaaaaatgggaagatgataaaaaatatcatcttcccaaaagttttacgattatataattatctggctatcaatgaacaactaccaaaaagtacacaaaattctatagctgattgtacgcattatacattaagttctgttgatatcattgatatccgtataagttataaagggtaaaatagttaaaacaccctatattcttcctataaacttcccaattatacagtttacaaaaaataaaatcaaatcaagaattacaattgtcgcacctaccggcgtggaacaaagaatagagagtacaattccaaagaaagcacctattactgaaagaacggctgcgtaaataatcacacctttaaatgactgcatcaccctcatcgctgaaagtgccggaaatataatcaatgccgagataagcagcgagccgaccaggctcatggcaagtacaataatcactgccgtaataattgcgataatcatgttgtaggtttctgcattttttccaattgcccttgtaaagttttcatcaaaagttactgcaaaaatacgattataaaataaaataaaaaatgcaacaactagtatcgacataattatacaggtaaaaacttcggtttttgttaatgtaagaattgttgtcgaaccaaataaggttgaacagacatcccccgatacatttgcagaggtagaaaagaggttcatgacaagataaccgactgccagtgagcttaccgaaagcattgcgattgcggcatccccctttatctttgtattctgtccagttcgaaggagcaaaattgccgcagctatagtaactggcataataaaaatcgtattatttactaatttaaaaattgtagcaaccgccattgcaccaaaggcaacatgagaaagaccatctccgataaaagaaaaacgtttcagtactaatgttaccccaagtaatgaagaacacaaagcaatcagaactccgacaatcaatgcataccgcacaaatggataagataaataaaaagaaagttcctgtaaaatatgtgtcattttttatcgcctcctatcctgttttcctctgcatttttaaacaatttccatttatcactgttcatatattcttcctttgtcccataaaaagagtttttcttttgcatatgaaggatatgtgttgcataatcaagtgcctgtacatcatgagaaaccatgatgacagcgattccctcttcacttaaatcttttgtcacctgataaaactctgccgtcacctttgggtcaagccctgttaccggctcatctaaaagaattaccttactcgctgcgcacaatgctctcgcaagaagcgtccgctgctgctgaccgccagaaagattccgataacaggactttctgagcttccacacttccatccgcttcatcttctcctcagcaagcttcttctctgcttttctataaaatggtctccagccacatttcgcaagtgtaccggaaaggacaatctcctccactgttgctggaaagtctttttgtacgactgtctgctgcggcagataaccaacttcgtatgccttaaggccatctcccgtaataatgtcaccactaatggcatcttgtaaatgaagtaacgtcttaatcagcgtactttttcccgttccattctctccaacgatacaaagataatcgcccttactgactttaaaatttaaatctgatacgatagcatgtccttcgtatcctaatgttaagtctttacaggtaatataagccatttgtatctccacctctttctctaaatttcttccagcacattttttaacacactctagcatagtaatatttgcagggtactgtaacaattaatttctataatgccgtaaaaatatacataaatctttgtttcgcaaacttaattcaaagcctccgacaaaacagataaattctcttgcattacctgtaaataagtaataccatccgcaatctgctcctttgtaactgactgcaaagaattcatcgccagaatcttctgatttttctttgttgtattactttttaccgcttctgcaatccgaccatccgaattttcaatcgtcaatataacaggaagccgcagctcatctgccttttttgcaagaaatgttaccgtttcaaacccagccattgtctctgcactacatccagcaaaagcggcataatactttaagtcataatcatctgccatatatcggaacggaaaacgatctccaaataaaatcgctttatactttgcattctgaattgtgttcgcatactgcttatctaatgtatccagttttttaatataattctctgcattggtttgatagacttttgcattgtcagaatcaagctgctcaattgccttttcaatatttttcaccataatttctgcattacgaatagatagccaaatatgttcatcatattctggttcttcatccgctgcttccttttgcccatttatttcctgagaattttcatgactttccttctgggtttgctcctgtttttccttcgaagatttttcatgagaatgtcccagagattccctttcttcctgcattccttcaacaacttcttcctcttttacaaaattgcccaaagtctccataagatttatcgcctttaaatctttatttttcgcctcttttaaagcatcctcaacccatgtatcagactctccgccaacatagataaacaaatctgacgaaccagcagtcgcaatatctttcaccgcaggctgataactatgcatatctacaccgttatccagtaaaagagtcacattaaaacgttctgcttcttctccaagaatattcttcacccagtcgtattgcggaaaagtagtgcagacaatcgaaatcttattactgttacctttctctatgctgttttgctctattgtattttctgattcagcattctttcttgtagtattttttcctgaagtatttttaactacagaacatcccactgataaaacaatacatagaaaaagtcctgccagtaacagagaacttgctgataacttttttttctttttaaatagctgtttcataaacacattccttctccctttataaataaatttcctttataaattttcttactttttattgggaaaatgtaatcgaaatttaatcgtgaataagtattatctccaacaatcaaattgcaaaataaaaaaacgcaaatcaattgcaatttcatattctagacactttcgataaaaatgtcaagaagaaaatgcaaccaatttgcatttttactatttgattcagttagagaacagacgcccgagaaaagaaccgataccctatatttgtgactttagtcgcggcggtttaaatgctcgctcatgcgctcgcattcaacacttgtgccagccttcattttctgttcttttctctatatacatcaacatccggtatcccatgcccctctactaatgcctttttcgccagtttatcaacccgctcgttataaaaatctcctgaatgtgcctttactttctgaaaaataacttctatcttctcctgcatccgcttcataaaagccgcatacttcttagtatgtggatttttggcactccatacaccagttgcccacttttcgattccctcataatcgtagtgaataacaacagaggaatacccattttcaaatgcccactgtaccgcatacatcgcaccatgcatctccccggctacattgcgaatcgctaataactccggctcctctccattcccgcttcgctcaataattcttccatcttcaagtaaaataacacagccaaaagagtatttttgaatacttacatcaaaacttccatccacataaacaacaagcctgtcggatgtcgaagttgttagtgcagtggaatctacaccagttgctgccgttgaagaattcttattagtaattattttagctgctccaatatttaaaaaagcttctgcttcttccttcgttaaaaatcctttatattctgctccggaatatccatacaccgcttttttacattcatcccatgtataaaataaacctgttttatgtccttttcttacagcataaattttcttttttgccattctatttcctccatatttcgttgatataatctctcttgtttattgcttttaaattatataattccttttctggatgttcaagtgaaaaaatattatatgtatggacgaagctcgtcgtacagatgtagtataagttaaacaataaaagatatttctttaaaaatactatatttttacctcattttatgttattttatcttatataattttttattacaataataattttttctgattgacagaagttatttaatcagacacataaaggagcaactatgacagatttactttattcttacacaaccaccgtaaaatttctaggcagtgtattaggaccagattatgaggtggttcttcaggatttatctaatataaaccactcagtaattgctatagagaatggacatatcagtgggaggacaattggcagccctcttacaagtgctgtattccagatgctttcttcaaaagtgtatgaagaggatgactttattgccaactataaaggggtagcagaaaatggacatatccttcgttcttcaagtatgttcattaaagattccaacggaaatccgatcggactcttatgtattaactttgatgacagccgctatatggaacttcatgaaaagttattttcgctgattcatcctggaaattttgtaaaaaatatatcatctggcatagcagaatccaaagaaaatgtaaaagatttatccagccggattaccgaaaacttcgccattgatgttgcttctcttagagaacagatttttaatgatgcaacagccaactttacaacacctgtggatcgtttaaatcaaaatgagcggaaggaaatcatgatcaaattatatgaacaggggctattccaattaaaaggttccatcccgtttgttgcaaaaagattctcctgctcacaggcaactatatacagatatttgggagaaatcaataattaaataggaatttgccgcaggcaagacagacgctcccaaagcgagcaggaaaaacaacactctagtgaaattacagacaaagccattgcccccaataaggcatatttgtgattttagtcgcggcgtattgaatgttcgctctattcgctcacatccaacacttgctccgagaccacaaatatgccttattgagggcaatggcttctgtgctgtggatagagaaggtgaattaaatcttttgtccgtttatctgctgcttcctctgtaatatccttttctataacgctttttcatttgatgcaatacttagtgaatcaaacgagtctttttatcattttttctttttgcatggtgtcagatacgataattttacccagccttcctgtcctccatactccgttcttccccaaccgtttttaaattctttcatttcaagatacgtattttcagggacttttgcgatacttctttgatcctctcccggtttttcccgaaagttaatctgctgggcactgcttaatgtctctactttccaggctgctttactgctctctggatagcatcctgcataataaagatttatccagccggttcttccattattacttactttaccccagccgtccctggtttcctggacgataaattctgcaccataaggaattccctttaatactgcatcagaggtaacatctggttcttgatacatacgaattcctttttctgttgaaacattaatataaatctgactgtcttcttgtatactaatcgattcctggcaaatatacttaagatacgacattttcatccagccggaaaggccggcatattttacctttccccatttctttccttcttttatcgtgctatctgttaattcacaaagttttccttctggcagggaaccaatcggtacacttcctcctgcctcatcataaattgggacaccatctaaagaattactctttatcgtacaccaggttcctgttcttttctctttccagatattttgttcctgcctcttctctcctatttcttccgtccaccagctttttaaataggaaaatgtaaaaaggaaaacagcagccagacaaagcaacgcgataatatctattaattttttatataatttgggcatgactttttctcctttattttacacttcgtgacactttatatactgcaaaaaacagattcccgctggcttctatttcatccaccgctttatatgtaagatgctctgtatcttcctgtcctaataaattcaaaacatttttctttccttttgttataatgtatacattcttttttaataaaaatcctgttcctaaattagaaattccatctttcgcaagcttttcttcatataatggagaatatgctgtccagcttcccgacatataccagtttccctgatgaagatcatcttttacaccagaaggcttgccaaaactttgtgtatctaaaatataataattttctttatgttttccgcagtaggctgcaatttctgctttttgtccactgcctgcctctcttccagcctgtattccctgtatcgcttgtattctatcacttccatttactcccatatgtaaaataactgccagtaaaatacattgaataacaacagaaatacggataaatgaagtatctttccaaaaagaaagcaaatgacatacaatcataaatccaacgctcagcatcaataaccgaatactttcttctactctttgcggaaaacgtccgttcattgcaaggtaaatccattctatatgaataagaaatgcacaggtccctccataaagaaaggtcgaaacccatcttaaaaatccatttttccatttaaataacaacgtgactgccgtgagtggaacaatcaggaaccacacataaaatccagaaaacttcaagaattctcctgtctgctttttcttcatgcaataacgatatgctttttcttttgcattctctgctttttgctctaatgataactgaagctcttgtgtcttctgataattataaattttctcgatagtttctgtagagaagtcatcatacagacagtaactataacttttaaatactttttgtgcattttcactcacaccaatggattgataaaaatcttcgttttcttcataatccggcagccccgtataatcctgcatataagcccttgcatgattataaataaaataatttttccagcccattgaaccatacatctgggtatttaaaaacaatataccagctcctaaaacaccacagactccgaaaatgaaccacggtttaacagaacgaaagaaatccattctgtatttataccatatttcaatcagcaaaaatggaatgaccatataaaagcactgttttctcatacaatatgccgatattcctaaaataccaagacaaagtaaattccacggtctccacagttcctctttttttgaaaatccagtaaataacagactcatgcatccaagaaatgcagcaactgtagaaaatgtcagatgaaagaaacaaggcatccacacataaacaaatgcaagagtgtagaaaaagcatatcaaaattctgttacaccggaaataatttaatattcgaaataataccaccgtaagtgcaaaaacttccaataaaacaattgctgtcacataccagtttgtcccattatctgccggaaccgtaaagggcagctttggatttaactcgtataactttgctatgatccatgatagtggatattttataaaaatcgcatgtccatccgaagttcctgtataagaaccatctaaaatctgtacaatagctgcatcatcatttacctcataagtaaatgcaactttattgcacattttcatcataaaaggaagtacggttccaattgctaaaatcatatttatcacaaaatttatgaccttgttggaaagaaatttatgataggaatcaaacgctttccctaaaaaagagcccgcctctcttccctctgcattttgcctgctcttttgtatctttcctttattttttcctttgttcataacaatcccctacttttctttacaaattttatatatctattataccaaatattttacaaaactgcttctgtttttttcatgcattttttagagcgtgtttcagacacgctctagtcacattttcctgctttccgaaaccagtgttctttcttcccctgtccggtaatccgatttaaatctactcttccgggtattccaggacagattccattggaagtaaattgctgcagatctgcacctttgtgcgcactatatctagggcggtacacagcgtcatttaagccgtaacgcgcttcccaccaggcacatcttttcgggcggcgccgaataattctctcatatctttcatattcagaatacattgtataaagcatcatcttgtgtctctgccttttcaaataattcagggcactctccactccgtcttccgtatttccggattccacatcaagcacatatcctataaaatgtttttctacccgctctttacacacttccactaaaaatctggtctgtgcagtctcatcccctctgttcaaaaatgcatataaccaatatggaatacctcttctttcacattctcttatattcgtatctagcgtttcatcaatataagatgtcccctgggtcgcttttgcaataagaaacggacaattgctctttacttttccccagttacgtacaggatgatagtggctgatatctggataatagttgctcatgatggcctccattgagaattgaatatatttattctattcacaaatatgttatgtgttactatttaattcattagacaaactacagacgaagccattgcccccaataaggcatatttgtgattttagtcgcggcgtgttgaatgttcgctttatgcgctcgcatccaacacttgctccgagaccacaaatatgccttattgggggcaatggcttctgtgctgtggctggagaggatgaattaaacaggaggtggggatttggggacagaagctgatgtattctgcttacccgagaatatacgcaaaagacaaggaggtttttgtatgaagaacaacgactcaccattcctgctaccggaaagcatgactggagcgactggtggatcgtaaaaaaatctacggtttttaaaacaggaacaaaaaaaagagaatgttggatctgtgataaaacacaaacggtttctattcctaaattaaaaccatttgtgaagttaaataagaaaactatttccttaactgccggaaaatcatatcgtttaaaggcatcttatgccaaaggcgattctgtaaaaaaatgcaaatcttctaataaaaaggttgctactgtctctaaaaaaggagtaattagcgctcgacaagctggtaaagttcgaattactatctacacaaaatccggtaaaaaggcaacctgcaaagttactgttactgcgaaaaagaaagccgctaagaaaagttcctctaataagagcggttctggtagtggttcttcaaaaacaaacggcagtactgtttattggacaccaggcggtgcagtttatcatcgcacaccaaattgtccgactttgagtcgatcaagaacgatttatcatggttctatttctagttgtccgaagaaccgcggatgcaaggtgtgcttttaaattttgatttgcgcagcaaaggagacacccacagggaatataatatcctatgggctgtgttttgtctgcctaaacgaattcagaatttattccaactggttttctgagctgccaacgcacagaactcctgaagataaataaagcatatttgtggcctcggagcaaggtttggatgcgagcgctttaagcgaacattcaaactgccgcgactaaagtcacaaatatgctttatttagcttcaggagtccgtctgctttgcagcctcgcaaatcagaagccgctatgctatcattccccgaatgcttcctctcattttgcgaatgaaagagattactaatccaagtactgcacagtaaaatataccattgtttccggtaaatgcatgtaaaatccactggccgccagccattccattatatccaaaagtaaggaatccatcaataaatggagtaagtaccgtaattactaagaataatccaaatgcgaaaattcctcttccggtatctatgtttctaagtactcccatgtccattacttttttagaaccaagaatccacagtgcttcaatgattccaaacaggatgaagaaagcacttccgccgataaatacaatggtgtctatatctcttgatgatgccagtcccataattgtacttacgctggtatagttccagacattcttaaaaatctgtaatacaataccaatcattaataaggcgcaaagccaatgtaaaccggtaaaaaggatatttcctgctgtctttacactctttcctacaacattacctgctgtggaggctgcatttgacacagcatctccaccactacttaaagcggaacggcgctttctctttgtcgttgttgtgtttcttgatgagccgcctcttttattctttatcgtgacttttacatttttctgtttgtctttttgtttctggtcttcttcctcatcatataccttatattccgcatcaatggattcattgcttttctctgtagatggctcttcttttggaagcggagcaccacagttcttacagaaattaccttctgcttctgcaccacaattgctacaaaacattatgttcacctcatttcaaatatcttgtataataataaagcatttttacacaaaagaaaagaggggaggtttcttgatttttaccagggaggagacaaaccgaaggaagcatatctcatatttcctcagagtttcgtctgtcagtctgtttatctctcttcacacagggacattaccaaatgattcattactttttcacaccttattatatcccgaatctctacaaattcatctggtttatgtgcatactgcaggcttcctggaccgtaggacatacattctgtattgtgcagtcttccggcgatgactgcggtatctgtgtagccggtaaaggctttaacgactgctttttgttttgtttctgcctctacggcttcttttaagtttttaagaagtatagaatctggatttttctcgatatatgggcggtttcccgtaatatcgtaggaaatctttattcctggtatctgggtttcgatttctttaatgattttattaaaatgttgaacaacgatttgatcggttaccggaggtgctaaccggcagtcaatgaaaattgtgcaggcatctggtactacataaggctgatagccgccttgaatctggccaaatgtaatggtagagtagccaagttcttcatgcactggaaaatgctcaaatatttcttgtatttgtacgataaactttgatgctgcaaatattgcatccgctcctttttctggcttgctggcatgagcggtaattccttttacatgaacgtgaaaccatagtctgcctttatgtgccatctgaatctcaccatccgtcggttctaagtctaaaacataatcttctttttttacgaattcctgttctacgatatggtcggagccggtcatatcgccctcctcatcgatagtgcatatcattcgaagcggacattttaaagaaatttctcctttttcaaggcgtcttgccgtctttttaaaagtcgctaatgcacaggcaagtccggacttcatatcgcagcttcctctgccatacattcgtaaaattccattctgctcttctatttctgctccaaatggattcttcgtccacccctctcctacaacgacagtatccatatggcagataaatataaacattggaacttctttgtatttttcttttatactttcttcttttgtattttccggccacaatgtggcaattacattttttctgccatttcctacatcgtcaagctggatttcgcaggaagtatcctttagataagcaaggatagcctctctcattgctgcttcttctgttccaggatttgtactttctattttgacaaatgttctggtaagttcaacactctcttcatatgtttccatttctacttataacacctctcaagaaactttcaaaatattcgtattattctgcttataagttttgctgccccttttgtatttttttagacgatgctgctttttcctctctttaaatatttaccgtctcctctttcaccgaggaattctccgtcttttacaagaatctttcctctctgcattacaaggtcgattttaccttcgatctctcgtccctcataacaggtataatcggcagcaccatacatttttttctttgtcattgtccattttttctttggattaaagatcacaatatctgcatcagaaccgacagagagtgtacctttttgtggatagactcctccgacctttgctggattggtacaggcgtattttacaagctgttccatggaaattttccctttgcacacaccctcagaatataataaagataatctttcttctactcccggcgcgccacttggacattttgtaaaatcatctgctccctgctgcttttgccttttgaaagtaaatggacagtgatcggttgctacagtatcaatttcattgtttttaaggccatcccataatgcctcattatctgctggctttcgcagtggtggagccatcactgcctttaacccttcagatgaatcatcatacaagtcatctgtaagcaatagatactgtggacaagtctccactccgatatgtttctgtcctcgtttctttgcctgacgaatttcttctaatccctcttttgtcgaaagatgtacgatgtatacaggagcatctcctatagcacttgcaagatataacatacggtttacagcttctgcttctgcttcatttggcctgcttaatggatgatatcttacttctgttttcccttctcccacaaatttctttcggaagtaagatacgataccatcattttcacaatgaaccgtaattaaaataccatcttcttttgcctgttttaatacacgaacgatgtcttcatcagaaagtttatagtcataggtcatataaattttaaagctggtgattccctcgtctttgacaacttttttcatttcttttaatatatcatcattaacatgctgaaaaacgccgtggaatccgtaatcaactacagcattatgatctgcaagcttgtgatattcctttacctgatgcatcagattgcagccttttggtccaaatgccatatggtcaatgatagttgttgtaccaccacaggccgcagcaatcgttcctgtataaaagtcatcaatagcccttgcaatcccgacatccaaatccatatgtgtatgaatatctactgcacccggcataacataacatccttctgcatcaatacactttgcttccgcgtcttctatgttcgtatcgatttttatgattttgtcatcttctaataacaagtcagccagaaatgttttttcttctgaagcaatggttccgttttttataagccatttcatatgttcttctccttttcgtataatcattacaagttgagaatataaaagaatcccgttatcacagtacaatctgtatcaacgggaagtctttctttataagaacatatcgtaatggcgggtttcccttttcctgattctggcgggtttcccttctcctgatatggttctcgtatgattattttaactattcagaatcaggtgtatttttcataagcactatagacactataggagttgattctgaatagttattcatcgtaattatttctcagaaattacagctaccgcttcaatctctacttttgcgccctttggaagagcggcaacctgaaaagctgcgcgtgctggatatggttctgtgaaaaattctgcatatacttcgttcattgctccaaagtctgcaatgtcctgaagtaaaactgtagtctttgttacatcactcatatctgctcctgcagatgcaaggatgttcttgatgtttgtaaggctctgttttgtctgtgccttaatgtcttctccagcaaattctcctgtcgcaggatctactggaagctgaccagatacataaattgttttctctgcctgtactgcctgggaatatggtccgatagcagcaggtgcattgtctgtatgtaatgctttattcataacatttgctcctctactgatgaattaatgttcccgtctttccggcaattccatcttttgccttctcaagtaaggtgataagagatgttcttccctctccagactgggtaaatgctacggctgcctgtacctttggaagcatggaacctgctgggaactcaccttcttcaatgtatttctcagcaagttctggtgtaagctcggaaagtgcctcctgttctggtgtgccaaaatggatggctactttttccacagcagtaagtataatcagacagtctgcatttaactgttctgcaagtttctcagcggcaaaatctttgtcgattactgcggctgcaccttttaagtgatgtcctcctgttttaaatacaggaattccaccaccaccacatgcgatgacaacgtggttgctttctactaatgctttgattgtgtcaatctctacaatagatactggtttcggggaagctaccactctgcggtagcctcgtccggaatcttcgattaccttataacccttctcccttacaagctcatctgcttcttcttttgtcataaaggaaccgattggtttggttggatttttaaatgccggatcatccggacttacttcaacctgtgtaagcattgtcgcacagtctttctgaattccacgatctaataactcttcgcgaagtgcattctgaaggtcatatccgatatatccctgactcattgccacacatacagataacggagactgtacatacttttcaggatttgatcttctgagttctgtcatcgcattctgaatcatcccaacctgtggtccatttccatgcgcgataacaatttcgtttccctcttcaattaaatcagcaatcgcaactgctgtattctttacggctttcatctgctcttcaaggttgcttccaagtgcatttccccctaaagcgatgacgattcttttactcactctaactataccccctgcgaattaataaacgacttaaattattcaccgaagtgtcttggggtagctttgtctgctaatgcttctaatgttccagtgatatctttctgttttgcaagaagaatcatagctgcgatgatgtatggtttgtagcttgcttctttgtataatggatcacggtatctgtcaaatacagaagcttcaacttctccgtctttgcaggatacaccattgatgtctgctggtaagcagtgaaggtagagagcttttccgtctttagttgtagacataagttcttctgtacagcaccagtctttatgctctgcgttctgcgcaagtaattctttctctaatgcatcgattccagcctggtcaccttctgcatataagtctgtacgtttttccatagctgcaaaaggagcccagctctttggatatacgatatcagcatctttgaaagcttctgccatagagtttgtctttgtgaagcttccgccgttttctgctgcgtttttcttagcaacttcttctacctctggcatgatgtcatatccttctggatgtgcaagtacaacgtccataccaaatcttgtcattaagccaacaacaccctgaggtacgcttaatggtttaccataacttggagagtaagcccatgtcatagcaacttttttacctttaagattctctacaccaccaaatgtattgatgatgtgaagcatatctgccatacactgtgttggatggtcgatatcgcactgaaggttaactaatgtaggtttctgctcaagaacaccatctttgtttccctgtgttacagaatctactacttcatgcatgtatttgtttccttttccgatgtacatatcgtcacggataccaataacgtctgccatgaaggaaatcatgtttgctgtttctcttacagtttcaccatgagcaatctgactctttgtctcatctaaatcctgtacttctaatccaagaaggttacaagcggaagcgaaagagaaacgagttcttgtagagttgtcacggaacaaagaaattcctaatccagattcaaatacttttgtagagatgttgttctctctcatgtaacgaagtgcttcagcaacagtaaatacagcttctaattcgtcatctgtcttttcccatgtaaggaagaagtctccgttgtacatttctttgaagtttaatttgtttaatttgtcaatataaccctgtaatttcttgtccatttttattctccttattttgaaatactcttttattaacttgtttattttatttatctaaggtaaaaagataaattatttaatgtcgttatttgtttttccagcgcggaactgtgaaacatcatctgtcttgttgtcttcgttgtaaaggtttgctgctgcaacgtaaactgctgcacatcttactaagtcatctttgtatgtgatttcgtttggtgcgtgtgcctgtgattcagctccaggtccgaatcctacacatgggattccgtaacgtccctgaattgctacaccgtttgtagagaatgtccatttgtcgattaatggacggtttctaagttcttttctagaatctggtcccatacgtttatctccgaagagtcccttatgagcgtctactaatgcctgaacatgagcagcattttctttgttgatccatgttgggaagtaacattctgtttcgtatacttctcctgtccatgatggacggtcatacatatacatggaaactttaacatcatcaccgtatttctgaacgctaggaagtgcgcggatttcgtctaagcaggaatcccatgtctcaccagcagtcatacgacggtcgatggagattgcacagctatctgctacagcacaacggctaggagatgtgtagaaaatctgagatactgtacatgttcctcttcctaaaaactgtgcatcttcgtaatgttctgggttgtatttagggctgagcatcttaacaaggcctttgatgtctgtgctttcgtcacatccgttgttatttaatgctcttacatcagcgatgatgtcagccatcttgtaaattgcattgtctcctctttctggagcagaaccgtggcaggaaacacctttaacgtctacacggatttccattcttccacgatgtcctctgtaaataccaccatctgtaggctctgtggaaattacaaactcaggaacgattttgtctttgttgtaaatgtactgccagcacattccgtcacagtcttcttcctgtacactaccaacaatcataatcttataaccttctggaatgaggtctaagtctttcatgattttagcaccgtatacagcacttgccattccaccttcctggtcagaaccgccacgtccgtagatgatttcatctgtttcatatcctttgtatggatcctgttcccagttatcaatgttaccgatacctactgtatcaatgtgagagtcgattgcgataatcttttcgccatctcccatccatccgataacgtttcctaatccgtcaacttctactttatcaaagtttaacttctccatctctgctttgatgcaggcaacaacttctttttcctcacagctttcgcttggatgagaaatcatcgcacgaagaaatgctgccatgtctgctctgtaattttctgctgcttcattaattttctgaaaatctaatgccatttttatcctcctaaatattgcattcatctacagttggtaaatttcacggagtctgaaaattgggaatattaatttctctccgaccacactgcccttaaattttctttatttcatttatctaaaagatatttttatacggttgggtattcgccgccccatacaatcttcttatatttatcagggtctgtatctccctctgtggagaacatgagcacctgactggagttatctaactccaatgcttctctgagttctttgtaagcatcgtctgtcataatagaagaaataactcccattcctaccgctccggattctccggatgttacggatggatctccttttactggagctgcaagcattctcataccctttgcagatacccagtctggacaggaaataaatgcggaaacatggtttcttaaaatatcccatccaattgtatttggttcgccacaggcaagacctgccatgattgtctgaagatctccaccaacgattcttggttcgccatctccagcttctgctcctttataaaggcaatctgctgcgccagcttccattacgataaatttcggtgggttgtttggataaaggtttgcaaagtaaccaacaacaccgcctgcaagacttcccacacctgcctgtacaaatacatgagtaggtctgtttacttctacttctcttaactgctctgcagcctcaccagccatacttccgtatccctgcataatccaggaaggaatctcttcgtatccgtcccatgcagtatcctgaacgataacaccatgtggtgtctctgctgcttcttttgctgcaagtcttacacaatcatcataatttaactcttcgattgttacagaagcaccttctttcgcaatattatcaaatcttgtctgtgtgcttccctttggcatatgtacaacggctttctgtccaagcttatttgctgcccatgcaacaccacgtccatgatttccgtctgttgcagtaaagaatgttgcctgtccaaagtcatcgcggaacttcttgcttgtcagataatcatatgtcatctcactaacatctttacccatctcttttgcaatatattttgccattgcgaaagaaccgccaagtactttgaacgcatttaatccaaaacgatagctttcgtctttcacaaataaaccgccgagtccaagctgtccagccattccatcaagctttgctaatggtgttactgagtactgtggaaagctgcggtgaaactttcttgcctgatttacattatcaagtgccattaccgcaagattcttatcttcattctttggcatctgattcaaaatccatttgattttctccattgttttcctccataaaaatagtctacaaactttttgttaggtgtaatgaaaagttttttgttgtctttattatagtggtataacggcagattagcaaattcttctttggaggtatttgaaaagagacgaaggtgctgaaaacaaagagcccctatctgtgactttcttcgttacgagaagatatctagtcaaaaattcctccttaaatatattgattttgactccgttgtaaaaaacacaaaagtcgcaaaatcaatatatttaaggaagaacttttgaccatatcgtactctggcaactccgagaccacagatagaggctctttgttttcagcaccttctgactttggcaaaatataggaaagataaatttgttatctacgaaagagatttggggggttcgtctgtttatctattacatctgttttacctattcctcttctttcttttccagcatatggctttcgagaaacattttctcgaatttttgttctgaaaaacttatgacctgttcttcaaatctctggcaggtgatcaagaactgacggccgtcttcagtgaggaaggtttttcctccatttcgtccgcctcggcgtctttttacgacagtatagccgagtttgtcttctagttcattaatcatatcccaggcttttcctggagataatgccattgtatcacaggcttttcttacattattcaagtcttctattaaaaaaagtaataattttaaacgggcattgaagaacggggtttcgtgtccaattccaaaagtaaggattggatgaaggatggatttattatgttcttcaatccggctttgcagttcatcatcctcctgattaagtgataatactccaatatcatctacctcaacaaatactcttctgcctgcatatttttcgatggctccccgcagtccgttttcaccatcataggcaaggatatcaggaatcatttcattggaaatgagcactggatgcccagcttttttcttataagaaggtacgacgatatcatcgtgatattttcgcatctccacgatggtcttcggaatgaacatgggggcatttaccggggtaaatacaacacttaagcatttatcctgtaaataagaaagaccagcttttaccgaatgaaatagttctctcttttcgtccgactcttctaaaattaaaaatactacattaagattatttagctgatatctgctctcgtagtcatcagctcctacaactactactattggaaacagacctgcctgctgcatggaaaggacaattcttttaatagctggaatctttcccgtctttcgcaaaggatgtgcgctctccttacttgccgctgcaataattccgcctacattgctaacaaacatagttttctcccttttctttcacaaatttacttatttgtaagtattataaactatagtaccaaaaaaagctacatttctgtagcttttttaacaaattttttatttaaaatagggattataattaatttactatattatttctatattatttcattttgtaaaagaaaaagatagaaatacaaattttatcacttatcgtcctatctgtttactgataagatgatattttatagagttttttactttatgtttacagatgaaatcagcattagctgatttcacgatagcatgtttgaaaaatagtttcagcaagatgtacagattgatttttgatttttcaaacacgctatcagaattactcttcttcttttggacgatagaaagtatcctctaatggtaattttgttctaaatttgccatcaagggcataataagctccctgtacagcaggggcagtaggaattgttgcaatctcgccaattccctttgcaccataggcaacatctaataacttctctttttctacatagatagcatgaatatttggaatctgtgtagaacggagtaagccaagtgttccgtaagttacttgaggaacgcagtctttaagtggccagtcttcggttaaagcatagcccattcccatgagtacgcctccctcaatctgtccctgaatagaggttggattcactacctttccagagtcgtgtgccgcatacacttcggttacttttccttttttatcaaggataacaacatgtgtcgcaaatccatatgcgatatggctctttggatatggcacatttgcaccaagtttatcggttggctcataatattcatagaaataattcttgccgtttaatttctctaagtcattatcgacttctttcattgcatcggcaagcttcactgccgctcctcttactgcttcaccagtaagaagagtctgtcttgaaccagaagttgtaccggaatctggtgcattctctgtattgcaaacagcgttgcggatttttgaaagtggaagtccggttgcctgtgccacatcctgacaaaatacagtagcacatccctgtccgatatcagaggcagccgcataaatcacgcagacaccatcttcaatcacaaggttgcatcttcctttatccggaagccctacgcctacaccggcattcttcatagaacaggcgattcctgcatggtctttattagcttcgtacacatcttttacagcctctaatgtctcttttaaggcagtagaacagtcagcaatctgtccgtttggaagaacctttcctggctcaatcgcgttacggtatcggatctcccacggagagatgcctacctgttctgcaagaaggttaataatggactctaacgcgaactcactctgacatactccaaatccacggaacgctccggctggcggattgttcgtataatatccaaatcctcggatatctgtattctggtaacagtatggccctacggagtgcgtgcaggctctttcaagaaccggtccacacagggaagcataagctcctgtatcaaaataaatctcacagtcaaggccggtaaaaataccattttcatcacagccaagagtgaaggttccttccattgcatggcgtttcgggtggaagaatagagactcctgtcttgtgaacttggccttgaccggacgctggtatttatatgctgcaagtgcagttaaatgctgtacggtaacgtcttcttttccaccgaagccaccaccgataagctgattttctactacaatcttttccggatcccagccaaacataatggatacttcttttcttgtatcaaatgctccctgatccgtacttaatattttaattccatctttatatgggaaagaaaccgcacattctggttcaagaaatgcgtgttctgtaaatggtgttgtaaatgaacgggttactttataggctgccttctctaaagcagttttggcatctcctcttgtaacgtgacgctgctggcataagtttccacttgaatgaatctgtggggcatcctctgccatcgcctcatggacattgcggatcggctccagcttttcgtaatctacttttacaagcttctttgccttttcaaggatttcttcagtctctgctacaacaacacagatggtatccccaatcattcttgtaatatcgccttcagcgatcataacatcccagtcctgctgaatatgtcccactttattatttggcacatcttttgctgtgagtacaccaagcacacctggaagtgcctctgcttttgacgcatcaatctttaacactcttgcacgagggtatttgctgcgtactgcagataaatgtaccataccatccataacaatatcgtctggatatttgccgtatccaagcactttctttcgcacatcgacacggaatgctctctgtccgacaccgtactgttctcctctttcaaggtcatagtcaatctctgcatctcctcgaagaattgctgcggtaagctgaattccctcgataatctttttataaccggtacagcggcagatattacctcttaatgcgtatttaatttcttcttctgttgggtctggattctgatcaataagtgcttttcctgccataaccattcccggaatgcagaaaccacactgtacagaacctttcgaaccaaatgcatagacaaatgcatcctgctctctttctgtcagtccctctaccgttacaatgtttcttcccacagatttatctgtcgttaaaacgcaggcttttactgcaaccccgtcaacaataatcgtacaggttccgcaggcaccttcactacatccatcttttacggaaaataaatgaaggtcatctctaagatagcgaagaagagactttttttctgttgttgtccggcgcattccattgacagtaaaacaatattctgttgccatagttctcctcctctcttatcttatggataaaataccatttttatcgtgaataacaccccgtggacatttgacggcacacataccacaggcgatgcatttttcctgacaaatgacagcgtggttatccacaactttgattgccttacatggacagtatttctcacagattctgcatccaatacagcttactgcacatccctgaatcgcttttgggcctttgtcaaggttagcacactgtggctgaatggtattttctgttggaactacctgaatcagatgctgtgggcaggcttttgcacaaagcccacatcccacacatttttcctcatcaatcttcgcaattcctctttcaccgattgacactgcgtgtaaccgacacgcttccacacagcttcctccaccgaggcatccataagagcatatgttaataccttctgaatactgtgttaatatttcctgacagttacctgtgacagtaacctgttcaaatccttcttttctggttggtctgccgttacaatggattacggcaactttctttcttctaacagccataatactcgcctgactatttcatcagataggaataatccttctgaattgtctcgatgaccgctgctgcatctgcggaaatagtacggatgccattgatgtccgttttttctactttatcatcaagacgaagatggatttctccgttttcttcacagtagaatccttcattttcgctgtttgtgaaatcttcttcactccagaataatgtaaatttatctttgtaaggtcttccagcgtatggacagaatacagcacagttaccacattcattacacataccatctacatggataacctgttcctgacatttaccagcaactttaattgcaacgtttgctctgtttggacatacatctgcacatgtctcacatacagtagaacatccaagacatctcttatctggcatctctgtaaggtcaggactctggtatcccttcttggcgatgtattttgctgaatcttctgccacattcgcttctgcatatttttcgtaggaaatacctgcaatggctgcggcagctttcgatgcatctgcgattgcttctacaacagtagctggtcctcttctggaatcacctgctgcgtaaacgccttctacacttgtcatcatgtttgcatctacaaccgggcggcccttgcggtcaagttccacacccatatcttcatataatgtaccgtcgatattttctccaacagctgcaattacagtatctgctggaacatattctacttttcctgtgtcaactggtgctcttcttccagactcatctgcctcaccaagttccattacagaacatttaagctgtccattctccacaccaatcggtgcaagaagttccatgaactgtacgccatcctcgatagcttctcttaattcttcttcgtctgcaggcatatatctctttgttcttctgtaaacaagacgtacattttctacaccttttacgcgaatcgctgctcttgcaacgtccattgctgtgtttccaccaccaagaacaacaacatttttaccaagaacaacttcaattttttcattctttgcatctgctaagaactctactgcatcaaatgcgccgccgtactgaagatgtgcgttaccaggtttccatgcaccgatggcaacgataacatctgtatatccttcttctttaagtgctttaatagaagcaacttctttacccgttacaaactctgcaccgtatgctttacaaagtgcaacatctttctcaatgtcttctctcttaattcggaagtctggaataacatttcttacaacaccaccgagattttcagacttttcaaatacagtaacagggacacctgctcttgaaaggaacattgctgcagatagacctgcaggaccaccaccaataacagcaaccttcttatctgttcttgcttccggttttgcaatattcttaagaactgtttcataggcggcatccgctgctgcatattttgtctcacggatatgtaatgtttcttcgtaatagttacgcatacatttatctccacagtgatgtggacagatagttcctgtgataaatggtaatgcatttctttctaaaatgatatctaatgcctttgttgcatcgccctctgtcattgcctcaaggtaagctgggatatcctgtgcaatcggacagccattacggcaaggagctgtgaaacagtcaaacagtggaagttctttttccatatgtctttctggtaaaggttttactggtttcttatataattcatcgcttgtaacagcgtcatctaacgctgcgattgcttttgtatctgttccgtggaatctctctgtaccgcattccatgaacttctcgctaatctggcttaatctttcatatccacctggttttaagatatttgttgccattgtgattggccagatacctgcgtcaaacatttcacggatattgtagattgttgctccaccagaataagaaatacgaagcttgccgtcaaactgttcggataacagttttgcaagatgaatacttaatgggaacagggagcgtccggacatatacatctcttcgctaggtaattcttttgcagcaacgtcaacagggaatgtgtttgtcagttttacaccaaactctaatcccttttcttttgttaatgccattaatctttctaacattggaatcgcatcatcccactgtaagtcttctacaaaatgatggtcatcaaatgcaacataatcaaatccaagctcgtctaatctctttcttgcatattcatatccaagaagagttgggttacatttgataaatgtatgaagatgtttctctgtaataagataagtagcaattctttcgatttcatccggagggcagccatgaagagtagattctgtgatggaactggaaatgttagagctgatagacttaatatagtctgcatctacattttcaaaagaatctacattctctaatgcccagttgatacactctttaaatacttctgtatcttttgcctcgatcatatcatcaatgaatgtatttaccttttcggacttaattccttctaagtcatatccaacagacatgttaaatacgaatccgtctggattgccaagtcctaattctttggcaagaatcttacatacaacccatgcttttacatactcagcgtatgcctgtgaaacatataactccgtagaccattcacagttatagcactcatctcctgctgtaatacatggttttgcaacgcaggcagaaagttctgcaccatccattacctgtacagtctttaattcaaagaatctggaaccagctacataagaagcaatgatgttttgtgctaactgtgtatttggacctgctgctggtccgaatggagattcaatcttttcctcataaataggaagtacctgtccgcttgtgtaatgtacaagcttatcaataccaaaaatacttcctttctttttgtattcgcttaatgcccagttcataagatgtccaatagacatcggtctcataatatcgctcatagtactctcctctttattatcattttattttagtaagttctgtgatttaattccccccagagcttcttactctgttccattgtccacgcattgattgcatcttcatcaatgtttacaaattcacggtctttataaagtacttttccgttaattacagttgttctacagtttttacccatcattccgaaaatcatatgcccatcaatgttttcgtctgaaaatggagtaaatggtttgtaatccataacaataacgtctgctgctgcaccctcttttaaaatacccagaggctgattgaagtatttctctgcgatgatacggttgttctcgaactgcatcttcacatcttcacaccatgcaacattaggcattgcctgctgatgtctctggataattaaaaataccttcatgctctctaacatatcatgcgtatacgcatccgttcccataccaacagtgatacccttttccatcatcttaagaactggtgcacatcctacagcattacccatattagattctggattgtttacaaccatagttcctgtctctttgatgatatccatctcggcaggacttacatggatacaatgtcctaacatggtcttttctccaagtaatccgttatataacagtctgtttactggacggcatccgtagttgcgaatactatcgtatacatcattcattccctctgcaacgtgaatatggaaacctgtcattccatcatttgcttctaccattttttcgaaggtcttatcagaaattgtaaataaggcatgtccaccaaacatagcttttaccatatcatcatctgcttcttttgcccattttgcaaaatcagcgttctctttgatactctgtaaagttttctcctcgccatctctttcagaaacctcatagcaaagacaggaacggatacctaattcttttacaacatctttaatggcaaataaggaacctgaaatttcaccaaaacttgcatgatgatcaaaaatagtagtcacaccatttctgatacagtctagaacagttgcatatgcacaggcttttgttccatctaaagtaagatgtctgtcaattgcccaccatgttccatctaatacttcaaggaagtttgttggattgttgccagcaatagataagcctcttgcaagaccagagtagatatgtgtgtgcgcattgataagacctggcatgatcacgccgccctttgcatctacaaattccgcttccggatactttgctttcatttctgtcaaagatcctacttcttttatcttttctccagaaataacaaccgctccatcttctaaatacggattttcctgatcgcgtgtaattactcttccatttcctattaataacatttagctgtcctcctaaattttttttagattagaaattgaatttattttttttaactgatataatgaaatatactatttaaattcttttgattttgtctgctttatcctgtgataacggacttaaatagttataaaatattccatttagaaaggttttattgattatgaaaaaatctcttattgaattttacacaaggcttgctcatggtctggctgtacagttcggctctaactgtgaagttgttgtacatgacctgcagggaaaagacatagaacactccatcatcgccattgagaatggccacgtaactggacgaagaatcggtgatggaccttctcagattgttctggaatctcttcataatagtgagcaaaacttaaaacaggaagataagctcgcttatctcacaaagacaaaaaacgggaaaattctaaaatcaagtacgatttttattcgtgatgactccgataaaattattggaattttcggaatcaattacgacatttccttaatgcttgctatggaaaaagagctttcttccttcactggtactattgaagaagatactaccaaagaacctattgctgtaaatatcggcgatttattagatgaattaatcacacagagtgtacagcatatcggtaagccggttaccttaatgtctaaggaagataaggtacaggttgtccgtcttttaaatgaagccggcgctttcctgatcaccaaatccggaccaaaggtctgccaattcttaggaatctccaaatacactctgtatagttacttagatgaaataaaatcgaaaaatacaatctaatatatttataatcttccagaatcatcattattgaaattatatgattctggaaagattactttattctttcgtttcttctgtagtttctgctgctgtctcttctttcggaagaatcaaatttaataaaatagccatgattgtagcaactactacagaggaagaaccaaagatactgttaatccatcccggaagtccagggcctgataaacaatccgcaacctgtgtaattccgacacctaaagctacagacataccaactaccgttgtctttcttgctgtcaatccatcttttgtaaacatacgaacaccagtcatggcaatctgtgcaaatacagataatgttgcaccaccgataacactctgtggaattgttgttaatgctgctgagaatacaggaataaatcctgcaatcataagaatgactgctgccactaaaaatacgattctatttataaccttatttactgtgacaattcctacattctgactgtatgtcgcagttggaagccctccaaaaaatgctccaaaaatactcataactccctgcgtaagaataccaccctgtaactcacgattggttggaactctatccataccacccattgttgtggaagttaaatcaccgattgtctgtacagagtttacaatataaacaatggcaagtgatatacatgcagatggtacaaacttaatctggaagtgcatgaactgtggcacagccacaattgctgtcgtattagtaacactggagaaatctaccattccaaatgccaaagcaagtaaatatcctgcaatcattccgaaaaataatgaccctaatttaaaaattccctttgtaaaattacttaaaataagaacaattccaaatgtacaaagagcaacaacccaattcttcatacttccaaattcttttgatccggctcccccagccatgtattttatcgcagttggataaagagaaagaccaattgtaaaaattacagttccagtaacaacatccggaaataattttctaatctcttttacaaaaattccaaagataattgcaacgataccgccgataatttcagcaccaagtatcgttcccatatcaaattcaccaccaatagcttgaagtgtcggaacgtaagcaaaactagttcccatgatcacaggcaaccctgccccaatcgattaaaaatcgggaataactgtagtaatgttgcaatggcagtaaggagcaacgctgcctgaatcatcatcgttttctcactctctgtcaacccacatactcctgcaatgataatggatggtgtaattacaccaacaaccgctgctagtacatgctgcagagataatggtacaagtaaggatggctttggaaccgatcctttaaactcgtacaatgtactcgtgtcagcttctcttgttagttttttttcactcataatatcctcctaacataaattatttttattactaaataatttttattaggtttattataactcttcatactatttattgcaagttttttattatttttgtcaatatttaattaattttgtcaattattttgtgcatattgcttaattttattttattttttttgcgcactcacctaactttttttatgtgatttttctatcattctagaaaaaattgaaaattatcagttcgaaaaacgcttttcttaatatcttattgatattataatttcaacaggatgcttctgcaaattcttccttagaagaactcgtaaaaatcaggtaaataacggtttttgcaagaaaagaaggagtttttgatatttcaaaaactccttcttttcctgttatttaaaatagtatggaaatgttttcattgttttctaattattctatgtaactccacaatttcttagtgcttgtcataactccgtcaaagcccgctttctgacatatctttattcgttcttctgaatttataaatccaccggcgaaaaacttacctgtaaatatttctttaaacattggaagaaattctaccgcatgagaatatggccgaagttctactgccgtaaaattgactccttttagtgaacgtagtgccatttctacagaatgagaatcaatcagggaaatacgaaaaatagtttccagtcccatatgctgcatctgatttaactttgaaacactagaccctatcacaccatctactttatacagcttttttaacatttcaaaagcaattctgtcattaccaagtcctccaatcaattcatgatttacaataactttctgtccatttctatgacagttctctgtgagttgttttaaatttccaatatgtgcattcgataacaatacctctctgcattctgactccagcgtatattttaaatatttcacatcacggatagatggtacaactaaaaacccctgtttctccaactttatcatcctttcgatttttcatcccagtatgttttcataatttcatttaatcgacaccactctttatatctcttctcataaatagggaaagtgctatcatccggcaataccggttcttttacttttacagctttttcaaatgcatcctcatagtctttatacactcctgccccaatacctgctgcgattgctacaccctgtgctcccgtttcttcacaatctacaccaacaattggaacctgtaaaacatttgcaaatatctgattccatacatggctttttgctgttccaccagttaatcggatctcctttactggaagccctgcatttcttaaaaaatcaatatgatgtttatggataaaagcaactccttctgcaacagaataacagatttctgcataagacgtactcatatcaatgttaaagaaattcgcttttgcattcatgtgaatacttggctgtgcaacaaaaggactaaagaatacttttaccttctcaattggtaccatctcaataagttcatcaagtacagcatattgagacaagtttctatcctgcgcctcaagttttgctgttccaccaagaattctcgtaaaccattcatagttagaaccagaagctccggtataagaacagtttaaatattctccttttttcagatacggcatattggacgatgcattcgggatgattcgatcggaatgtgtttcattgatacaccaggaaccggcaacggcagtatatacctcctctcccgttgctcccgcaccaaccaggcatgctagtatatccatcattccggctgcaacaggagttccttctgcgagtcctgtaatttctgacgcttcttttgttactgttccaacaatttctgtcggctctgtcgcaagttttggcaatgcatcatataattccggaattccgtataaatccatcagttctctggaataatccatcgtattcatatctaccataaaggctccgccaaaacaatttaaatctgtagcaaatacattagtaaggcgatacataatataatctttaaactgaaggattccaccaatctgatcataaatctccctgtaattttccttataccagcgaagaatcgggcctggttctcccgcaaataatgtaccttttacaatatcattaatcttttcgtatgttccttctctctgatacatttcaataatactgttggcacgataatcctgtgaaaaacagcctggcgcaatggcatatccctctttatcaaggaaaacaactccattaccaaaggaagtaactccgacaccggcaatctgctctggtgcaactgctgctttctctactgcctcttttatacatactgatataagattccacaactctgtaacatcgaattcttcaaagccttctccccttcttttaaaatgcatactcggtgttgctgctgtggcaatcatcttcccatataaatcaaaaataacaactttacttgatgtatttcccgcatcaattcccattaaatatttttccatgtgtaaccctcctgaaattccgtatattttaagcttttcctgcggaacctgtaagccgtattttttcttttactaccttctttaccgctttaagtggttctctgtttgcattgctcatccagattgccatcgttcctgctttttcaagttcttctttcattgtaccaaaataagccgccatcatttctgaatagatattaagcttggtaactccgagagaaatcgcttttttaatctgatcatctggtgttcctgaacctccatgcactaccataggaatatctgaaatgctatttaataattccagtctttcaaaatcaagttttggttcatgaacataaacaccatgagaagttccaacagcaaccgccagacagtccactcccgtttcggcaataaacctcttcatctcttctggattggtcagataatcttctggattgtcgtaattgccgtcttcctttattacaccagaaacaatgccgtctcctacatgaccaagctctgcctccaccgttgccccatatttgtgtgcatagtctgctgcttcttttgacaatctgacattttcctcaaaaggatattcagaagcatcatacataacagaagtaaagccggcatccacacatcgttttaagaaattcatatctctcgcatgatcaagatgaagacatacaggaacactcgctttcttcgccaaatctttcaggctctctgtccagtaggtaagcattttttcattgccctgctgtaagtctggagtcagtcccataacaataaccggcgatttctcttcttctgccgcttctacgatagccattgccatctcaattgtgcttgcatcaaatgcccctaccgcgtaatgttcttttcttgccttctcaagcatttctttaatatttactaacgccatatcattcttcctttctattaatacttttcatgataatttttataatttttcctgtttttacctgcattttcctattacttgcttatgcatacttactcattctttcaatctatctcatcaacataccgcctgttgcatcaaaggtaatccccgtatagtaatccgcacattttgatgctaagaataccgctgcctgtgcgacctcctcgggctcagctacccttccaattggaattcttccattataataatctggctttgccttcaacgcttcctctgtcatcggtgtcctcaccattccgggggctaccatatttacattaattccatattttgcgacttctcttgcaagagaaatactaaagcttacaagtcctgcttttgatgctgcataatgtgcatgtcctgttgttgatccgtgaaatgctgcctgcgaaacaatgttaacaatctttcctttctgctgagcagctatcttttcctgcacaaatttctgacacagcaaatatggtacttctaaattcacacgaatcgtccgctcaaaatcttctggcttcatatctactacatatgctgtcggccagattccagcattattaatcaaaacatcaatacttcccaaatccttttttatgacatcaaagatgaaatccacacttgaaagctctgaaaaatccacacaatatccctgaatccgctcatcctgatatttttcccgaagttccatcattatctcatgcacttccttctctcttcgtcctgtaacgactggaattccttcttcctgtgcaataagttctgctatcgccttcccaagtccttttgtgctccctgttactaaaactaccttatcttttaaaccgtaatccattctgtcacccctgtttcacaaaaaacggctaaagtcttctttttctcaaatttaagaaaagaaaactttagccgtagtacttaatcttatacaacttaatctattttgttctggaaaaattataacatatgcacaaagagactgtcaataaaataaaaagaatacattaagttaactatattataccaaaaataattcctcatatgtttaaaaaacacttggaaatatccctttagattctatcattttatccgcaaaaactatttcttcatttccattagtgcaactaacttcctggcagcgaatattgcaaatgcctcatcattaatatgtgcatccacgtcaatgacttcaacaagaggattgtttatcactttctttaatgtaataaataacgcctggtcttccctcgggccatagtattcacttcccactttatcattcatagaaattccctgaagtggaagtagcaataccgcattattcttacactgattcagtttctcgccaactttaataccaaatgtaacattttcctctatattactctttacaactgtgatagccggattatgcatatagacaactctatccttatatttttcagggagactctctctttcaccaaatgtaatcatatctgcagcacctaccgataccacctgcggaacaccattcaatgcagccgcatctaaacgtcctgtaccagctgccataatacctccggcaatttcatcaatccattctgttgttgtcagatctaatacaccatctacaattccactgttaatcagagattccatcatctttccgccagttcccgatgcatggaaaataatcacctcgtatccttcctgctcaagatattctttcgcacacataacacatggcgtcgttactccgtacatcgtagctacgatcaatggctttttgactggaatatctgtattctcatgttcaaccatcccaacaatagcatgaaccgcatgtgtcagtacctgcgaggaaatacggttaattcctgctacatccacaatggaaggcatcatcaaaatatcacttgttcccacatatcttgacacatctccagatgccatcgttgataccatgattttaggaacacctaatggtaataacctcatacacggagtcacaagagaagttccgcctgtgccacccaaagcaagaacggcatcaaacagcttctccgcatataactttggaattaaggcacaaagccccttagacatcacttccatggcatatccccggtcttttttctcctgcaattcggcaacgcttcctcctcccaaaacagcaaccgaatcatgattaatatctggtgaaaaaacctccttataaatgccagcatgaatcgttaatgttcgtaatcccagattctctattttattttttacatagagatattcctctccctttgtatcaaaagtgccaattaacgctattgtcttcatttttcccttctccaagaaatcaacttctttccaaaaattatcctaaaatgtgtttgaaatctactggggatatacagataccttttaatttttcaaacatactttattttattataataaaattactccacaattactgggaataattcagagtaatattaggagaaaaatggttttgtaaatattatattttttatcatatattaaaaacttcgccatcctccggaacccacacatttcccttgtaaaattgctttgcttcctctgtataccgctcttttcgctttttcccggtctggtcttcagtatgccagattaacagattctttacctttaaatcctgtgcaatcttacttgcctcttttaccgtttgatgttgatattggtacgcatgaaacttcggttcttcatcaaataagcagaaagcttcggataatagccaatctacatttttactatattttttaccattttctttcaacggctcatctccagcaaataccagtttctttccattatcatactccatcaaaaaaccatattgtttcgcttttgtagaaccaatatcaaaaaatgtaaaatcataatttaaaatatgtttcctttcatggtcttttaccaaaacaaacttaattcttgtctccaaaaaagcctggcttcgtttcttaagaatcatgcggcacacatgtaatacctttcccaatactacatcgtttccgtaaagataaaaatccccctcatattcctccagttctaacaactccgcaatcgtgcgaattacccatatcatccctaaaaaatgatcggtatgttcatgggaaagaaaggcataatgaagcttcttccaattaagattcatagtatcaaatgcccgcaagatgtcactgccccctgtcccgtccacaagaaataactgatcatcttcctcaaaaacacaggaggtattgatatatttacttactgttgctgttccagtgccgatgatgtgcattttcattgtaaaatctcctttgtattttctttgattaatacttccttctttccagcggattccctttcgggtttctatgtaatcagagggttacaggtctccgtttcacttcggtcgttgcaaaacgagtgccactggcactcagcaacctctgttgaaagactaaccgcctaccgttatgataacactcatgttcggattataacatatatcctttatcgtcacaatatgtcattttaatccccataacttacattatattgttacaaaaaagaacacataccatctagcatgagtccttaaaaaaatcctatccctttctatttcactttcagccctttaaaaatcttcgcataagtcttcttcactttcttcggcaccttaattaccatctttttatttacacccttaaatgccttcttgctggctgttttcttggtgagttttgttgtcttgatctttacacttaactgctcttgcgttctggtttttctgttcttttttcggttaaaccgaaatctaaagataaaaaaataagtctatcatatggcacgccatatacagattcaatttttcttaaaatcgggatatctggatatgattttcctctttcataatttcctaatgtgtctgtacttactccaattttttgtgctgcctctgattgttttaacccattcaattctctggcaagttctaatgatactctcatttcacttgaaactcccatcttatttcttcctttcttattttgtatctgtattataatttggtttaaccgaatttttttcggtttatcttgatttttttcgtttttaccgtataatcaaatcaaacaaggaggaacaccaaatgagtaatctgggaaataagcaaataatggctaataatataaggtattatatgaatattcactctgtatctcaaacagaaatatgtaatacattaggatttaaaatgccaactttctctgactgggttaatgctaaaacttacccacgaattgataaaatagaattaatggccaattattttggcgtaacaaaagctgatttagtagaagaccattcttctcgttctcatctgactcaatgtcaaactaaagatgaagaaaccttagttctctcttatagggaattaaatgatattaacaaaaaaagtgtcgcatacacaaacaatctcttatcaactcaacgtatggaagacgaactccgcaccgctcacgcccgcactgatatagaagcaactccagaaggaatccaaagtgatttagatattatgaatgatgatagcttatgggattaagaaaggagaattttattgtttcaaattatttatggtaaaaaggctatcaaatttctaaagaaacaagataagcctacacaaaaatgtttgatgaccgccatctccagattaccattagaaggtgatataaaaaagttacaaggagcttctggttatcgcctgcgtgtcggtaattttcgagtattatttgatgtaaatggtgttatcattgatattattgatattggtaatcgtggatagatttataaaggagtgtgattatatgtctaatgtaaaagaaagaatctttggtgctgttactatcatgagcgatgaagatgctgagaaagtctggaatttaattcaggcaacatttttgcttaacaatgtagaagaagttactcctgatccagatgaaatcgctgctcttaatgcatatcattctggtgaccctgattatcagcctgcaatgtctcaggaagaagttttaaaggaactaggattatagcaaatcgctacatgggaaggtggtgtctcacttgacatatgaacagcttttagatgctgccgatcaggagggtctggcagtaaaagaacaaccactctctactcatgatggtctgattattggaagtcacatagcaatttgaaagtatattacctgcttacaaatatggttgcaggaacttacatgagatggcagagcatctcgatgttacagaagaatttttaaaagatgcactggatgcatatctcttaaaatatggaaaatgtactgtagtagataattacatggtattttttgaaccattaggagttgtagatatgaattatggaattgaataagcgattagaaaaactaataaaggcactcaaaatgaatcaaaaaggactgtttctcctaaaacatgggacgatattgaagaagttgaaccaaatgaagttgatttagccatgttaaaagaagtcgaagaaaactccgattgtcatgaatttatttcacaagaagaggctatgaaagaattaggattatagtttaaaatatttaaatatcctcatcaaagccaagggataaccttggcttcttttttacgcttaaataaaaatgaggacaattctctattttttaatatctatatgcattttttcgacatttttccgcttttattgtataattgaaaatgaaacattttagtttcaattcatatgttattacggaggaaaggtaccatgggattatcagatatttttaatatcggcaatataaagaaggagaatgaagaactaaaagaaatgcttacacctgatatgaatgatgccattgatctacaacataaaatcaacgattttaataagtaactttcatctcttgaatctgaactcaataagaaaaagcaggaaatagaagcaaaatctaaagaattagataagatttcaaaggatatcattactttttcagatgaagtgctagttcaggaatatggtctttatcaacctcgatataattttatgtcatctgatgtttataaggaacgcttaaccaccattcgaaatcaacaaaaacaaatgataaaacaggatattgctgcctctggtaatacagactggacggtaaataacaataaagctaaaggtcgtaaaatggttaatgacatgaaaaaattattactacgagcctttaacagcgaatgcgatgagaccatcggaaaagtaaaatataataatatagaaacttccgtacggaaaatcgtaaaaagcgccgaacaaattcaaaaattaggaaccatcatgagtgtatatattaatcaatcctatatagatttaaaaatagtagaattatatctggcttttgaataccaacagaaaaagcaacaggaaaaagaagaacaacgtgaacttcgtgcccagcaacgtgaagaagcaaaactcaaaaaagaaattgaagaaaagcgaaaaaaaattaagaaagaacagacccattaccagcaggcacttaaaaatcttctgtcccaaatcaaagaacatggtgagaccgaggatttgatcgcaaaaaaagcggaattagaaactgaactttccaatattgataagtccataaaagatattgattacagagaagcaaaccagaaagccggatatgtatatgttatttcaaatgtagggtcttttggtgaaaatatttataaaataggtatgacaagaagattagaaccgcaagatagagtagataagcttggagatgcctctgttccgtttaaattcgatgttcatgccatgatattctctgataatgctcctgctctggaggcagctttacatcgagctttcgaagacagaaagttaaatatggttaataccagacgagaatttttctatgtaacactcgatgagataaagcaggttgttaaggaaaactttgataaaactgtggaatttatagacttccccgatgctgagcaatataggacatctttaaagatgagagaacaattgctcgcataatattaaaaaaagagaccagagatgccatataatatcatcatttatactgttctctttttatttataaaaattttatctaaccaaatatctgttcaatacttctataagtttatccttatatttatacaaatcattcaatgattcgatgtaaaaacgaataaattttttattttcatctggaatcaataattgctttttccttgtatccagattaattctgcatatctgcttccaactattattcttataaagtatcccaaaataactctctgtgtccttatatttgatatcttcaataggcacagtatcagctaacataccacgaataatattaaaggactcaatttctgcctctgttgtcacaattttagatactggctcttcattcccctgttcttccgtattttctgtttcatcttacatggtatcaaaaacctcatttaatttttgatttacgatatcatttataaaagctgaaaatgctttcctaaccataggtttgaatttctcaaccatatttttgtttttcttaccagtatatatgtcattaagtacaaatcggacaaattcatctgatggagtatcaaactcatcttcgaaaacttttttaataagagtactatattttaattcttctgcagctttgtatatattagatttatcaaatgtctcttttctaaatttcattaatgcctttattcctgattcatttatattttcaagattcacctctacaaatggttctaaatccatgatattatctttttcaagatctgtatagaatctataaacaatgccatttgtaagtattccaaatttaactggagctgcggcaaaatatctaaataattgacttgcgtgcttatctaaatcttcgttacaggatttgcattctacaaatatgcatggctttccgtctataataatcgcataatctactttttctccctttttaatgcctacatctgctacatattctggaaaaaattctgtaggattaaatacatcataccctaaaatctgaaaaaatggcataataaaagaggtttttgttgcttcctctgtaactactgagttttttaatgtcgatattctttttgacaactgcttaatttgttcattgaaatccataatactattttctcctaattgtataatttttttattatataatatcaatttttattcataatttatattgacaaatcgtacaaaatatatgttcatctaaactaactggatacttaatgatatttttctgaaacccaaaatgaataatatgctacaaaccaggatatacttgaattatctgactcaatatgatatattgaagtcagaaaagagtaaatggtgatatcatttatgcaccaaaaacccctcggtaccgctaataccgaggggttttatttggggcttggttgccgttgttctttacttcttcttccggccaaaccacttgctaagtaacttcataatcatctcaacaatgattcctgaaataataccagccaataccgaaaaaagaaaagagtataatgatatcatttgtgcacctcccttccgtcaccagtatagggagcggcaacgatgggattataacataattttctaaaaaagtcttaaaaaattaataaaatcttaatttcttaaaatctcaatttgtgatataatcaaaatataaaaaaacagttgacataatatagatattatagtagactaatatagtttttttgccagttagtatataattgataatatagagaaacaagagtctaagaactcgtcaatgaggcattgcgacctcgcacctaaaaaggattacattcaaaatgtaatcctttttattttgtccttttttatgttataatgtatttaattataatatgggaggaaattatattgaatgatgtaaaattaaaagacttatatatggggctacctgatggagaagttgaagctcgtgataaaagatttcaagaacttttctttgatcccaacaataaatataatgaaataataaatagcaatgaaaaatttttgattattggaagtaagggaactggaaaaacttatctttctaaatatattgtagaacaatctccttctaaacagacctgcatcatagttgatcctaaaaatttttggatatgtaaactcataaatattgatgagcaagaattaacaaatgattatatttcagtattgtgcaaatggtttttactatatgaaattgcaaattcattattaaataagcatcgttggcttaaacatcttcccagatgcaagctaaataagctgagaaaatttatgcttgaatacaatgatgacacattttataaaatagtatctttatctactactaataatcaagagattactggaaatctttctcacggtatttctcactctgacaagttacagacttcgaattttcaacactctgccggaattaaaacatctgatggggtttcttatgagagtacccgcaagagattttttgatttaattgattattttgaacaactcgtttttgattgttttcaaataaacgaccatctacttattattttagacgatttagatgaattaaaaaaggaagctggtgaacaaagcgaaaatattatatataatttgataaccgctgccaaaaaatataatttttattttaattctcgtgccaagagtcttaaaataatcatgctattgcgcagtgatatattaaataaaatgcagggaaatcatcctaatctaaataaaataaaaacctcctgttccatagatttatattggttacttgactctactcatgataaatgggaccatcctttaattagtatgatttttcataaaataagggcttcctgcgaaccctataaaaatcgttcaaacaaagaactatttgaaatattatttcctgaatcaattgacaagaaaaatcctcttgacttcttattagatcatagtcttgggcgacctcgtgacattgttacatttctaaactgtgcaaaaaaagaatttccggagagaacgtgtttttcagctacagttttaaaagagactagaaaaatttatgctacagatttttataatgaaatgctcaatcaagcttctttttacaaaagtagtgcttatagtacgcaatgtttaaaattaatagctggaattaaaagaccatctttttcttatagtgatatccaaactctttatgaagaaaaccgaacttcttatagcgaaattgataatcttgatgatgccctacattttctttatgaattaggggccatagggaatgcgtggaaatcaaaaaaaggaaaacatcgtacctgttggtattataaaatagatgctatagatgaggttgatttatcccaaaatttcactattcattatggtctaaggaaaaaattttcattatagccttttaacatttttcaacatttccttgcacatatgttctgcacgctgtataatgaccctataaacggaaaaaatccggtacttgccataccggatttctagtaacctatcaaccaggatggctgataatctttacatcacttagattataccacgcatcctgcattttgcatagggtgtattttttatacccttttttcgaaaggatgattttcatgggaaaagttagcacacgaaaacgcggaaaaacctggcagtattattttcaattggccagtgtgaatggaacgagaaaatggaaaaccggtagcggataccgaacaaaggcggaggctcaggcaaccggcacaaaagctttggctgaatataatagcactggtattgcttttaaggtctcggagcaatctgtagctgactatttcgactactggatggagcattatgtagaacaagaacttgcagagacaactgtaaatacatacaagaaaaggatccgtctttatattaaaccttatattggttcttacaaacttaaaaatgtacagggagaaaccttacgaaactttctggccgagttacaccgaactggtatgagtagaaatactcttacttgtattaagggaatgttgacatctgcatttggatatgcgactgtacaggcaaagttcatttctgtggatccgtcttacaaactgacacttccaaataaaaggaaagattccgaggtaggcacaaggaaagagaatcatatttttgttgaagaagatatgtggaatgcgattattgaacgctttccagaaggccatccttcccaccttgctctgatgcttggctattattgtggattacgtcttggagaggtctatggattaacctgggattgcgtagactttgaaaacaaaacaattacaataaataaacaaatgcaagaaccttctggatgtggtaagtggcttctgtatgtacctaagtacgattcatccagaacggttactgttggtaacaatgttcttgccttgctaaaaagaacgctggaatttcaattgactgataaagaaacctgcggagaatattatcaagaaaattacatgaactatgatgaagaaacacacagccttctttcacttaatgatttaaggcctgtacattttgtaaatgctaaacagggtggtcttctggctcacccacgaaatatgcagcacacttcccgcagcattcatggtaaagcaaagaactgtactcttatcagtgaagaatgggacttccacagtttacgacatactcatgcaacaattctttatgaggcaggtgttccaatgccactgatccagaaaagactcgggcatattaatattcagacaacaaaacgctacacagatcatgttactaagaaaatgctttctatgcttgatgaagtaataaatggtgacaacattgacaacaacttagagtaaatgttgtcaatatgttgtcaaaacacaaaaatcgggagccgaacgactcccgataaatttttgtaaatctcgtaaaacctagaatctacctgccttagcagcctcttcaacgctaactgcaacggcaactgtagctccaaccatagggttgttacccattccgataagtcccatcatctcaacgtgagctggtacggaagaagatcctgcgaactgtgcatcagagtgcatacgtcccattgtatctgtcataccgtaggaagctggacctgctgccatgttatctgggtgaagtgtacgtcctgtaccaccaccggaagctacggagaagtatttctttcctgcttctaatctttctttcttgtatgttcctgctactggatgctggaaacgagttgggtttgtggagttacctgtgatagaaacgtcaacattttctttccacatgattgcaacaccttcacaaacgtcgtttgcaccataacagttaacttttgcacgtaatccgtcagagtaagatttacggaatacttcttttacagtgtttgtgtatggatcgtattctgtctcaacaaatgtgaatccgttgatacgggaaataatctgtgctgcgtcttttccaagaccgtttaagataacacgtaaaggtttctgacgaactttgttagccttttctgcgataccgatagcaccttctgctgctgcgaatgactcatgtcctgctaagaaagcaaaacattctgtgtcttcttcaagaagcatttttccaaggttaccatgtccaagacctacttttctgttctctgctacagaaccagggatacaaaaagcctgaagtccttcaccgattgctgctgctgcttcagaagcttttcttgcaccttttttgatggcgattgctgcacctactgtatatgcccagcaagcgttttcgaagcagataggctgaatgccttttaccatgccgtatacgtcaaggcctgcatcttttgtgattttttctgcttcttctaaggaagcgattccatagctgcttaatacggaattaattttatcaattcttctttcatatgattcaaataaagccattcttctctacctccttaattagtcaattaccttgtctgttctagggtcgataatcttagctgcgtcagctacacggccatactgacctgctgctttttcccatgctgtgttaggatcatcaccttttttgatgaaatctgtcatttttccaagatttacaaactggtaaccgataattaagtcgtcttcgtccagagcgattcctgttacatagccttctgccatttcaaggtaacgaggtcctttctgaagagttccgtacatagtacctacctgggaacgaagtcctttaccaaggtcttcaagtccagcaccaatctgaagtccgtcttcagagaatgcagactgagaacgtccataaacgatctgtaagaagagttcacgcatagctgtattgatagcatcacatacaaggtcagtatttaatgcttccataacagtaagacctggaagaatctcagatgccatagctgcagaatgtgtcataccggaacatccgattgtctcaactaatgcctcctgaattataccttcttttacgtttaaggttaatttgcaggcaccctgctgtggagcacaccagccaacaccatgtgtaaaaccagagatatccttaacctcttttgcttttacccattttgcttcttctggaatcggagctgctccgtgatgtacgccctgagccactgggcacatgttctgtacttcttgtgagataatcatgttattactcctttcggtataaattgatttttactaaaataacttacattccgtaagtaatccctaagtcaagacttttgtttgtcttcacagtttattattttctcacaaaaattgcttttcgtccatacttttttttaattttcgacagaatttttgatagaactttcacaattctctcaattttttctcaataaagcagtatttttgtggttttatatgttctattccgttgttccttcactctccatctcattacgatgagtgcttgaagcatctgattcggaagtgctgtcggtctgatcaggagccgtacttccagaaacttctgtttccttttgggcagtctgttctgccttctgtttctgataagcttctttaaaaatgtccttcatttttgcgatggccgctttttccgcatgataccagattgttttgccattcatatttgttacagtgaaatattcatcatatatcacaagcttcattgtatttccatgatggtaaaaagtataggttctgcctttacttactttttttgccgcttttttgccccattttttctttgcacgggcttcattcgactttttcttactcatctggtcaatataggttgcaacagaagaagcagcctcgttctcatagcatcttcctttatcattgataattaaaggtgcatctgctaagcgatggaatagtttggagtttggatagccatttctgaaatgtaaaaatgcatcgccgatagcggaagcattataggcataataaacattgttcggcaaatcagtaaacacaatgtaattaccgccatataccatgatttcataaatagcattatcttcatcataaaggatatattcgtatcctggcccgtacttttccttcacctcatctggcgtatattttgttgttttatctgctcttgacgcaatagttgttgctaaagaaaatactgcttctccctctataaattcactgccatccatgttgtcagcatagcccacttcaagttttacaagatgatcccgagatatcttttcaaggtaatcactggctctttgctcatcctctgtcatgtcgttctctgcatctacttttgatttcagggacttattctgttttttcagctttttattttctttttgcagttctttataataacttgactcaagtacctttttctttgaagccttacagccggtaagagaaaatatcaataccagacttatcaaaagaactacatatttacttcttcttcctcttttcatgatgtcctctgattttcttaatattcttctttctggactacttcgtttttatttttatagatggagtggccagcaacatatcctcttacgctggataatggatatatgttactgtgtcttcccacgatagttcctggatttaatatagaaccacaaccaacttctacataatctccaagaattgctccaatcttcttcatatgtgtctcaatctttgtatcatctaaatgaacctctactaactttttgtcagactttacattagaagtaatagagcctgctcccatatgggatttataaccgagaatagaatctcctacataattataatgaggaacctgtactttatcaaacaaaataacatttttaagttcagtagaattacctactacagctccctctcctacgatagcgttgccacggataaaggcacagtggcgaatctctgcatccggaccaataattgccgggccattaatatacgctgttggcgcaaccatagcagattttgctacccacacatgttcttttacttcttcatactcatcttgggaaagaagcattcctacttccataatgaagtcatgaatctttggaagaacttcccacggataggtgttctcctcaaataatacagatgcgattgttctgttaaaatcctgaaataattccctattttctaatcgtttcattttcttttctggctgcaaacagcctctcctttctatttatatctatgttactatctctttgtgacatcctctccacctgtagaggtggggcttcccaacctcggcaagtttggttctcgtttgataacactatatgctaagcatatgcgagctatccccgtgtgtcccacggaatgattgtataccattctcacacagccaaaagttttagcaaataaaatcttctgttcatcattcgggtatattctgaatttatatgctctgtttgccaccatgcctcttccttttccgcgaaaacccacctgcgatacttgaccacaatcacaagatgatagtatagtaagaatactaaatgtgcgttattatctcaatttattgtatctcaattttttattatgcgactaatgatactatactatatttaggatgctctatcaagtaggtagcagacgcaatttatctcccaatctcccaccttagaggtcggagtcttcttgctgtaagaggataaattcaagcctgtggaggatttgtatctataaattcaagcctccagttataccttccagtcttttcatctttttcatagtaaaaataagctgagaacttattgccacgtttacttacgcagcctctgaagcctacctttccatgctctagcaaaatctttaccatctcgtaagatactttttttccaagagaggtaataaaacggtcatctttccagatggcaaacttgcagccttttttccatcctgaacagccaaatgcccttgctgtctctacaactggagccccacattccggacagataccggcaggttccgtgtgcaaaggttctaatgtaacaggcccgccgaatactttatcattctttattttgtcaacagattcaatgacaaactgctctatcattgcgagaaaatcgtcttttgtaaatttctttcgctcaatatctgacaatgttttttccagacggcctgtatattccagatcaaaaagttctcttgccggaaatgtttctacaagtatttttcctaaatctgtacagcttaagctcttgccctttgccttaatatatcccgcatcttttaactttttaatggtttccgcacgggttgccggtgtaccgatactaaatccactcaaaatggccatcatcatctgttcttcttctttttcctcatatttcttcccgcaggtttccataactttaagaagtgtcttttccgtatgtggttttggtggttttcgctctacttcgttaatttctgactttataagaggcagaacatctccctttttcactgctggaagaattgtttctttggcatcaataccttcgattaatttccagcctgcttcaagctgtacctttccttttgcgacaaactctcccggaatatctgtattctgcatttttatgtgaagtactgtatcttctgcaactgcgattggcataaattgtgctaaaaatctgtttttcacagcttcatatacaattcgttctgactcatttaagcttcctggctgcatgtaggttggaataatcgctgagtgactttctacttttttactgtcaaaaatgcgctttgtacttttaaactgtatcatctcttcataagggcagctttttttatggatattcagaaccttagctgttttttccttgaggctttcgtcaaggacaacactcgccgttcttggataagtaataaactttttctcatacaattgctgtgccgtctttaataccctgtcagaagtccaccctttatattttgaagttatatagccctgaagacctgacagattaaaaagatagggagggtactctttcttatttgttatctttttggaaacaacttcaccatttttatctttaatcttttcctgaatctcttttaattcttcgggattatcgaacttttccccagcttttatataataaatactgtcgaacttctttttgtcttccgtctgaaaaatgccctttaatttataatattttgtcactttaaagtccgcaatttctttatccctgtcatagattatcttaagtgtcggcatcagcactcttccaacattcaacagacggatatttttctggttacggtatttcaaggtagcaactgaagtaaggttgattccaataagccagtctgcaatctgcctgccaaaacctgcgtcctgcaatgatttcatttcttcatttggctttaaattctgtaaccctctgtttacttcctctgctgtccactcatttaataagattcgttctaccggcttttgtggggaaatgtaattaataatttcatctgcgatgatctgcccttctctgtcatcatccgttgcagaaataattccctctacatccgatctttccatcaggctttttataatatccatctgctggacaacaccactatccggtttatctttattctttccatcagactttatcttatataaaaacttttccggaatatagggaaacttctcaatcttccagcttcgcatctccgggtcataatctcttgcatcatagagctgcaaaagatggccaaatgcccaagtaattatataattctgcccttcaaaatatccattccgccgggaagaagcggtggcatccgcaatgttttttgccacagacggtttctccgctataattaactttttcattgaattcccttctttctggatgtatttatgtaacgcaaactactataacataatttttttattctgtgaaccttagagcgtgtttgaaaaatactctggcggaaattcttctcttttctcattttcaaaaaaatgatatactattttcaataactatagtaattttcagttatacagcaagtatttttactgataatctacatttaatctaatctgcatcgctgaaaattactacaaataatctcacaatatactcaaaaacgtatacaaaaaggaggattacttactatgacaccaaagcaggaagcatgggctattcaggccgagcatgtaatcaaacagatggagcgcagacactttaatgcttattactgttctacaaaagaggaagctttaacaaaagctttatccattattgaaaagggttctgtcattgcaagtggaggctcagctactttaggagaagtgggtctgctcgattacataaagaaccattctgaagattacacctttattgaccgcagtattgcaaaaacagaagatgaaaaaagacagattcacgcaaaggcaattctgtctgattattatcttatgagtacgaatgcatttaccatcgacggacagcttgtcaacattgatgggaacggaaaccgtgtcagtgcactttgctacggtccaaagcatgtggtaattattactggtatgaataagttagttccttctgtagatgccgcttacaaacgaatccgtcaggatgcctgcccgccaaactgtgtacgtcttggacttactaatccatgcagcaagacaggcatctgcggagaatgtatgtctgcatcctcaatctgtgaccttttcgttacaacaagaatgtcacgttatcctgatagaattcatgttatcatggtaggagaagaattaggatattaattttttatccatttttaaaaaatattttgcgagggtatgtatcagcttgtcaaagtctaatggctttgcaatgtgttcattcattccagcctccttggcagcaataatatcctcgttaaatacattggcagtcatagcaatgactggaaccgttctggcatcctttcttttcagctttcgaatcctcttcgttgctgtaagtccatccataaccggcatcataacatccatcaaaatcacatcaaaactatcactttctgactgctcaaaaagttctaccgactctaaaccgttcctggcaactataatttctgctcctgcatcttcaagaatatactgtgccacttcaagatttaagtcattatcttctacaagcaatatcttcattccctctatagaagtttcttcctcttctgtctctgtttcttcgaaacagaccgtatcaagctttacaggaagtgtgatcgtaaaagtacttccctctccctgctttgtctcaagggtaatggttcctttcatcttattaataagattcttaacaatagacataccaagccctgtcccctgataactagagcgattctccgcatgttcctgtgtaaatggctcaaaaatatgttctgcgaattcctcactcattccaattcctgtatccgaaacaataaattcaaactttacatattctccatcacaggataactctcttgccgaaacaaaaatatctcccccggatttgtatacttaatcgcattacttataatatttactaaaatagaacgaacatagttcggactgccacagacgcatggatgctctatcgctccttctatatcctgctcgatcgtaagactcttttcggaagcaataatctcctgaactgccagcgtaccattcaaaagtcttatcatatcaaacggctcttccacaagctgaatacttcccgtctcaatttttgacatgtcaagaacatcattaatcagagacaaaagctgatcggctgccccacgcatctttgaaaggcataaatccattttttccggattattaagatgtgcctgtgcaatatcaagcattcccatcatgccgttaattggagttcgtatatcgtgagacatatgggataaaaactccgattttgcccgtaccgctgcctctgcatcctgtgtctttttttgcaacagacgctgctgattattaacaaaaatcagcaaaatcgttattgtaagagaagtattggcccacggcattgtattaaagaaacactgcaggaaaatcccaataaaaaatggaacaatgtaaaaaactggctgccataaaaccttccttttttctgcatttttttctttatgaattctccacaaactaagcaaaacagaatatgcattataaatattagctatcatcaaaatctgtggatacttataaatccattctgtccgataagatgccactattattatacaaagtacatcaattggtatatgtatcgtaatcaaaggtatacgctttttaaacatatccgagccatatatattttcgctatagcaaaggaaaaacaacgatatagaggctacagaaaagataaaagccgcatctaatataaacaggacattcctccctgcagtctgcttaaatagtattccaaacacatccgataaatcacagacacagacggcaatcagcaattgcagaatccacctttctgatttgccaaatcccggtgtcctgctaagcacatataccagaatattattaatcagcatcataaaaataacggtatatatataacttatattccatgcttccattttgattaccccttcgaattataaatatttattcataactttatgtaatactttcattaattcttgttttttacaagcatatttatgatagcatatattggatcaattttctatataaaatgtttttctttaacaatttccacttattttcaatcatttatgacacatagcataatgattaggggctatctgtacttttcatctgtatgccactgcatcagaagatacatttacttaatatgcacatcctcgccaaatgcgtattttggaatcaaaatcatatgaagaatactgaaggcatagaataaattctaactttgttccaacatccaaagtcagctctcaaagaaagaaaagaccctatatcagtgatagagtcactgatatagggtcttttctttctttgggaacgtctaccttgcctgcggcaattagaatttatccccctgatagattggatatttttctgtaagagacttaacgattgcttctgcctcttccagtttatggtcgatgatcgtaagcttaattgcctctgcaatctgtaccatatcgtcttcttttaatcctctagatgtaacagcaggtgttccaagacgaagaccacttgttacgaatggagactgtgggtcattaggtactgtattcttgttacatgtgatatgtacggaatctaataatttttccatgtcttttcctgtaagtcccatcttacgaaggtctacaagcatcagatggttatctgttccgccagatacaatatcaaatcctctttcgattaatgcatctgctaatacagaagcattctttacaatctgtttctggtattctttaaattctggtgttaatgcttcttttaaacatacagctttcgctgcgattacatgcattaaaggaccaccctggattcctgggaagatagctttgttgaagttatatttcttattcacttcatcgcttgataaaatcataccacctcttggtccacgaagtgtcttatgagttgttgttgttgtaacgtgtgcgtatgggattgggctctcatgaagacctgcagctactaaacctgcgatatgagccatatctaccattaatactgctccaacttcatctgcgatctcacgcattctcttgaagtcaatctttcttgcgtatgcacttgcaccggcaataatcatctttggatgacattctaaagcgatttctcttactttatcatagtcgataacaccttcgtcatttacaccataaggtacgcagtgataattcttaccagacatatttacaggacttccgtgtgttaaatgtccgccatggtcaaggttcattcccatgtaagtatctcccagattcattactgcgaaaaatactgccatgtttgcctgtgcgccggaatgaggctgaatattaacatattcacagccaaataattcttttgctctttcgattgccagattctctacaacgtctacatactgacatccaccataataacgttttcctggatatccttctgcgtatttatttgtaaggtggcttcccattgctgccattactgcttcggatactaaattttctgaggcaatcagctccagattatttctctgtcttccaagctcgtcctccattgcttttgcaacttctggatcaaaatccttcacataatcaaaactaaacatttctattcctccgttttctatactgcatcttctaaaacagatatgcatatggagattatagcatactgataaaatacaagcaatgattaaatcctatcgtattgtaggctttttagttaaaaatataaagttcctccgtacgtttacaattcttccctgtatttttttgcattacatagaaaacttttatcttaatttgcgtgagcattctcgtacattaaaaaaatactttttacaagatatattttccaatttgcgggaaattactttttatttttttaactcactcttaaaatatacgaaataccttttcaatgattctatcttttttcataaatattgcaaaaaatcataacacctgaatgacttctctcacattagatacaccaattacctgaatcttctgacaaatgttatctccaagtacttcggcattcgtttttggcataatacatctggtaaatcccatcttaatcgcttcggcaagtctctgctctacatgactgacaccacgaacttctccagtaagacctacctcaccaaaaatcaatgttccctcatgaacaggaagattgcgataacttgatacaactgcacagatgattccaaggtcaattgccggttctccaagtttcattcctccggcaagattaacataggcatcgcagcctccaagctgcattcctgcctttttctcaagaactgccagtaagagatttactctgttaaaatcaattccaaccgtagtacgtcttggcatattaaaacttgtcggagagactaatgcctgaatctcgattaacagtggtctagttccctccattgaacagacaaccacggaacctgacgcatccgtcggtctgccatcaagcattactttggatggattctccacttcgacgagtccctgctctttcatctcaaatacaccaatctcattcgtcgagccaaaacgattctttacgcctcgaaggattcggtaaatcgccgtctggtcccctcgaagtaaagaacggtgtccaccatatgctccaatgttttcggtccggcaacgacaccttcttttgtaacatgaccaactaaaaatacagcgattccctctacttttgcaagctgcatcagcacagaagtaacctctcgcacctgactgacacttcccgctgcagaagtaatttcttcgctgtacattgtctgtacagaatccactacaaccatatccggttttgcttctcttaccgcttctgccgccgcattaatatctgtctcgcaaagaagaaaaacattttgcttaaatccgccaagcctctgtgcacgcatcttaatttgttttaaagattcctctcctgaaacataaacaacctttttcccactgtttgcctgataacggcaaatctgcaggagtagagtagactttccaattcccggatcaccacctactaacgtaagcgacccctttacaattcccccaccaagaacccggtcaagttctggaattccggagcttgaccgatcttcctcttccatagatacttcaaataatcctgtaagctcctgacgaggcagattatctcctctctttccagtccctttagacaccggacttaccttctcctctgtcatcgtattccactgatgacaaccgggacactgtcccatccatttgggtgtttcgtaaccacattctttgcaaaaaaatacggtctttgcctttgattttgccatagataattcctttccaattttaataaacagaagccaaaagctttcgcccccaaatcttctctccacgaatttaattcaccccggacagccaaaaacagaacccttacaatgaaataatccatttctgtggtctcggagcaagtgttggatgcgagcgcgaaagcaagcattcaacacgccgcaactaaagtcacagaaatggattatttcattgtaagggttcgtctgtcattccaacgaataaaatttgtccaccatctattttactatttggacttttgctgtttctcctgcatctaattcgatgctgaaactgatttttccgctgagactggatttgagcttgccaatattagtatcgttaacatatactttgtattccttttcaggttctacttcaagagtaatctgtaagtcatccgctgcctctgtctcaaacacaatctggcgttctgtttctttgtaaccatgtacagcagaacctggtacagattcatatacaacaccgccatttttctctaagcgggtaatctcctgaaatgtttttactttatatgtatcgccctcaaatgaaaaatcatcaagctttgtcttttgtgtgagactataatctccaaagcttaaacttccattctcttctgcttttaataattcttttacgttagccattgttatatcctccgtatttatatctgtcaagttaccgttattatacaagaaaacgggaaatttttctacaaaaaacacataattattaaaaattattttacaaaatttctattgcagattatctagagtgtgtttgttgtatttttctactttttcttcttttctgctttcttaacaactggctttccatcgttaatatcgagaagaattctgtcattgtttttaatgtggccttcgaggtattcatctgccagaaaatcttccaattcattctggatagcacgacgaagcggtcttgctccatactgtggatcatatcctttttcaaggacatagtctgctactttatcagagaattccaaagtgaagcctggattttttgaaagtctgtcagaaagttcttttaacagcaattctacaatcttcctctgttctggtttttctaatgtatggaataccatgataccatccacacggttgataaattctggtttaaagatctgcttcacttcttccattacatgggacttcatacgctcatgatcttcctttgcacttctttctgtaataaaaccaagattcttcggtgccatgattcgctgtgctccggcattggaagtcataatgataacagtatttttgaagtctgcctttcttccattcgaatcggtaatctgtccatcatcaagtacctgaagtaaaatgttaaatacatcgccatgtgctttttcaatctcgtcaaataaaataacgctatatggatggcggcgtacctgctcggaaagctgtccaccttcttcatatcccacatatcctggaggagaaccaatgagtttggatacgctatgtttttccatatactcggacatatcaacacggatcatcgcattttcatcgccaaataatgcctcagcaagtgctttggaaagttcggtctttcctacaccagttggtcctaagaacataaaagaaccaattggccttttcggatcttttaacccaacacggccacgtttgattgcttttgcaaccatctttactgcctcatcctgcccgattactcttttctttaacgtatcctcaagaccaagcagacgctgtgattcgctctggctgatacgagttaccggaatctttgtccaggaagaaacaacctctgctacatcattctctgtaacattaacacggctgactgcttttttctgctcccagacttttctttgttcttcgagtttttccagtactgttttctgctttgtattattcattttggccttgcgcagattgccctccgcaagtgcctcttcttttcgctttccatatttatcaaactgttcttctaatgcccgcatttcatcagacattgtgtataagccgactctctttttagaagcagcctcatccataacatcaatcgctttatctggaagaaaacggtcactgatatatcgttctgataattctacggctgcctgaattgctccggcagtataatgaacatgatgatgctgttcgtacttttcctttaagccattaagaattgcaactgcctcttccttcgttggctcttctacggcaactggctgaaaacgtctttcaaaagcggcatctttttcaatatattttcgatattcctcacgagttgtcgcaccgattaactgaatctctcctctggcaagaaatggcttcataatattagaagcatcaatcgcgccttctgctcctcctgctccaatcatcgtgtgaatctcgtcaacaaataaaagaatatcccctctggaaatcacttcttgaaggagttttttaattctctcctcaaattctcctctgtatttagaacctgcaatcattcctggaagatctaatgtcattacctttttgtcccaaagcatttctggcacttctccacgcacgatccactgtgcaagcccctctacgattgctgtttttccgactcccggctcaccgacaagacagggactattctttgtacggcggcttaaaatctgaatcattcgctcaatttcctggcttcttccaacaatcggatctaacttcccttcttttaccctctctgtcagatccacacaatatgctgcgaccatagaattcttttttttcgccttctttggtgcagtaagtgactggaattctttctgtgctctcgttgaatctacccctgtcgcaactaaaacatctacataaattttctttagattaatattcatgcctttcatcaaacgaagcgcaatacaatctttttctttgatgatcgcaagtaaaatatgttctgtccctatctgctgtgcatgcatgcgaattgcttcttcttcgcttgtcaaaagaacatgttctgctttaggactgtatccgagaaacgtctgattcgcattatctcctaatgctgctgattctcccaatactgcctctaaaaaattctcatagttaagaccattctcataaagtactcgtccagaaagagaatctggctgtgctaaaagtcccagaataagatgttcggttcctatatatttctggtggcatgaagctgcatcttgcgctgctttctccaatgcctgggaagcatagttattatattctgttctcattcctatcctcgctttctattcttcctcttctatcataagaaatgtgtcatacatttcctctactaactgtttcatctcatcttttgtaatctctttgcagattgcctgtgctacaatcatctgcatgtatccattcaccttcatcatctcttctgatttgtcactaatctgtacagaaatgactgctccctttcttcgatcaagcttcagatagccttcttggcgcagcatggcgtatgccttattcaccgtatgcatattcacaccaagttctcctgctaagccacgcacagaaggaagggaatcccctcatggagctgttcctgcgcgatctgcatgacaatctgattgcgaagctgtatgtagattgcctccgggctgttaaaatcaagttttattctcatatttatcatcccattcttttaagatatcttctgtgttatatagactatatcatatagcgcaaaaaatcaagtccataaacaaaaaaacgtacaaaatgtatccttatctgacagtaaaatacatcttatacgttttctctcttttgattttttaaacatgctttaaaatgtataaaaaaatactctagagcgtgtttgaaaaataaaagttgcacaaaacatatattcccacgccctttttcatgataaaataaagaaaaaaggggagtttattatgttgagacgatatgaattaacagatgaagaatggaatcaaattgtttctctactgccacctgaaaattctggcaaacaaggacgaccatccaagtgtaaccgtaccattcttaacggaattgtctggattgcccgcagtggagcaccttggcgtgaccttccagaacgctatggcccttggcaaactgtctattctcgctttcgcaagtggatggaagacggtatccttgataatatctttcgtgttttaagccttgatgcagaattaagcgaattatcaatagatgcctccattgtccaggctcatcaacatagtgcaggtgcaaaaaaagggggccatccaacgaaatcggacacagtcgcggtggagcaagtacaaaaatccatgccattgtagatgcttatggttatcctgtttatgttatgctcagtgagggacagcgtaatgatattaattacgccatccctttgctagaacaagttgacataaaggaaagtgatatactggctgaccgcggatatgatagcaataaattaatggactatatctatgcccatggtggtgagccaaccataccttccagaaaaggggctaaatttgaccgttactgtgactggcatctttacaaagaaagacatttagtggaaaactattttctcaagttaaaagcattccgtcgaatagccacgcgttatgataaattagcatccacttttgcagcatttatatgcatcgcctcaatattaatttggttaaaatgaacaacttaaaatgtttttcaaacacgctctagagcgtgtttgaaaaatgctttctgcaagatgtgcgttacaatttgtggaaaattcgcctgaatgagggcggcgtagtgggctacgtcaactgaatgaaggcaaaatttcccgcaaattggggcgtgcagattgcaggaatgatttttcaaacacgctctaatacttatctgcgagaagctggcaatatagaatctccaacgcttcttttactgcgctgtgacgaaccccctgacgattcccgccgtaaaaacagcgcttcactatcgtacgtccctttacacaacatccaatataaaccagccctaccggtttttcttctgttccccctcctggacctgcaactcctgttgtaacaacagaggcatccgctcccgctgctcttactgcaccttcagccatctctgccgctgtctgtcttgagacagcaccatatttctcaagagtctccttttttacaccaagcagcttatgcttagcttcattagagtaagtaacataactttccttaaaaacttctgaaattccgtcggcatttacaagcgtgcctgctacaagaccgcctgtgcaggattcggcagcagttactgtcatcttcctgtgaatcaaaatccgtgtaattttcttttcaattggttcttctgccataatccgatcggaactcattatttttcattgcctccctcttttaacacatcaatgttctttgcaagataatctactaaagaaacaatcgtaagaattaatgcaatatatataagaatctgctcagcgatatgtattcctccagcatatgcagggaagttttctccgagattaagcatcagtaaaataattgcaaacatctggaaatttgttttgaacttgccccaataacttgctgcaataacaacaccgctatcgctggctactaaacggaatccactaataacaaactctcttgcaataataacaataacaatccatgcagcgatcttattctgtgctacaagacagataaacgcagaagaaacaagcattttatctgcaagtggatccataaactttccgaaatttgttacaagattatactttcttgcaatatgtccatctaaaaagtctgtaatactagctgcacagaacagtactgtagcgatccatttagaacctgcaacgaaatctgttaacaggaaaaatacaaaaaatggaatcataatgattcttacaattgtaagcttattcggtaaattcatcggcataaataacatctcccatcaaatcatattcatttgctcccgtaatgcgaacaggaacgatatcaccggaaatcaattcttcctccgcccggacaaatacatttccgtctaccttcggcgcatccatataagttcttccaatatagatatcgtcttcatataagtaaccctctattaaaacggacatttcatcatcaattcgacttgcagctttatcagcagaaatctcctgctgtaatgccataatctcatcccggcggctttcctttacttcttctgtaatctgaccgtccatctctgcagcttttgttccttcttctgctgagtatgggaatacaccaagtcggtcaaattccatactgtctacaaagtccaccatatttttgaattcttcttcggtctcaccaggaaaaccagtaattaaagttgtacgaagaacaatgtccggtatttctttccttaacttctctacaagagaaactaattctgctctattggtgcggcggcccatacgctttaatatcgtatcctcactatgctgaattggaatatcaagataatgacaaatcttcttctctttcttcattacagcaatcaattcatccgtaatttcttccggataacagtacaaaatacgaatccattcaattccttcgatttcacaaagttttgttaaaagttctggcagtgcctttcttccataacagtccataccataaaccgttgtttcctgggcaataagaattaattcctttaccccgccctcagcaagctttcttgcttcctctaacagatcttccattgggaaactacgataatgtccccgaatatatggaatgatacagtatgtacagcgcttattacatccttctgcaatttttaaataagcagtatatccaccagttgttactacacgtttatctgctaaggaagcaggaagcaaatcaatagaaggacaacagtttacaaaggacttctccttgggttcttctactgcagcttctttctgtgatgcctctgcctcagcaagaatctcatcaagaatcggaacaatctctgtatatcccgttgttccaattactgcatccacttctggaatctcctgctgaatctcatcctgataccgctgtgccatacatcctgttacaataagtgccttgagtctgccctttttcttccattctgccatctcgagaatcgtttctacactctcttctttcgcatcatgaataaaacagcaagtatttactacaatcgcatctgcctcggactcttcctgtgccacacggtatcccgcttcatttaaaagtccaagcatcttttcactatctacgaggttcttgtcgcatcctagtgatacaaataatacatttttcatcggttattcatccttaacgctgcttctacgcagttattcattaacatggcgattgtcatcgggcctactcctcctggaacaggagtaatcgcagaaactttatctactaccttatcataatcaacatcaccacaaagtttattctcttcatttctgtggattcctacatcaattacgacagccccatcttttacatagctgtcatcaaagaattttggctttccaatcgcagctactaaaatatctgctctctggcatacttcttttaaattttttgtatgagaatggcagattgttaccgttccattctctcttaaaagaagcatggacatcggtttaccaacgatattgctgcgcccaacaacaacgcagtcttttccatcaatagagatgccggaacgttttaataactggataattcctgctggagtacaagatacaaagcctggctctcctgtagataaagcacctacactctgtggatggaatccatcaacatcctttgctggagagattgcctgaataatctctttctcgtccatatgtgcaggcactggaagctgtacaagaataccattcacatgatcatccttattcagacggctaattaaactaagcagttcttcctgtgttgtctcttctggaagctcataagcctgtgactcaattccaatatacgcacatgctttctttttattattcacatatacgcttgatgcaggatcacttcctacctgaattacagctaaacatacagaaatgccttcttcttttaacagctttacctgttcttttaattcctctttaatatcggaagatatcttttttccatcaattcttaaagacatagtatctcctcttttcttcatttattatgtatttatacatagatattgtacctatttaaaatcaaaaagtaaacacattaacgatatttatcttcactttaaatagccacaagatatttaataatacaacaaatttttcatttcgtaaagtcctgccgccagttctttacaaattctttgcaatttttataaatattcctcaaaataggattctaactgttctgaagacattaatactttccgcggctttgttccttcttccggacccacgattcctgcatccgaaagctgatccactattcttgctgctcgattaaatccaatcttaaacattcgctgcagcattccaatggaagccttgtctttttcaataacaaagcgggctgctgcttcaaaatattcatctctttcctgagaaaccgcactgctctttaatttattttcaattttttcagttacttctgtatcgtatactgccacatcttcattttcttttaaaaatgtaaccacatcgctaatctcattatcggaaataaaagccccctgcacacgcaccggtttagagtatcctgccggataaaagagcatatctcccttaccaagaagcttttcggctccattcatatcaataattgtacggctatctacaccagaagaaacagagaatgcaattcttgatggtacatttgccttaataagccccgtgataacattaaccgatggacgttgtgttgcaataaccagatgaattcctgctgctcttgcaagctgtgataatcttacaatagcatcttctacttctccaggagccaccatcataagatctgcaagctcatcgataataatgacaatctgtggcattttttttatagtttctggatcaatctctccagatttctgaagttcccttacctttttattgtaaccttcaatattacgaacaccagtttctgtaaacttcttataacgatttgtcatttctgctacagcccagtttaatgctcctgatgcctttttcggatcagtaacaactggaataagcagatgtggaattccattgtaaatacttaattctaccatcttaggatcaatcatgataagcttgacttcttccggtgctgccttatataaaatgctcataatcaaagtattgatacacactgacttaccagatcctgtcgctcctgcaattaataaatgtggcatcttggcaagatctgttactacggtctttcctccaatatcttttccaactgcaaaagccaatttggatttaaatgttttaaatgtctgactttctatcaaatccctaaaatgtacggtctgattatgtttattcggaatctcaattccaattgctgcctttcccggaatcggtgcctcgattcggatatcagatgctgcaagattcagcttaatatcgtctgtcagagaaagaatcttacttacctttgttccctgttccgggaacatctcatatctcgtaacagaagggccacagcttatatctgtaattgtcacattcactccaaaactttttaatgtctcatacagtttctgcgctgtttcctgtaaatactgctgctggccagaggagtgtccctgttcttcttttataagaagacttgcgggaggaaacaggtaatcttttccttctgctttctttctatctggaactacttctttgctttctacagatgatactttctgagctgtttctttcttaatggtatcttgccttgccatttgcttttcttgaatggcaatatccctatcgttaacttccgaagcattatcttttgcttctgtatctctttgctttatctcagccccatttttccagattctgctctcctcattttcttcctgtttttccttcatatcctttactgcttctatctcagggacttctttctgttcaatcgcctgatcagccgcatccggataaacattttcttccgaaatggcttctgcctcagatacaatactttcagaaacttcttctatcaaactacccaaatcttcattgattcggatttcttctggcagtgaagtatggaatgctcccttttctttatatggtggggcatagctttcttcttgcacttctaaagtactctcttgtgcctgttctgaaattaatgaggtattttcctctgggaatgtaaacgcactgaaatctaacttacctttaaatggttctgtcttcccatcctcttctgtgaatggataaatctgcggatgaagttcccttacacaatcctttcttttcacctcatcagaggaagtaaacaccggaacattcacctttatattttttattgttttctcttgttctgctgacgtagatggctgctttttcgggttctttttctccttcttttcttctagttctttcaccttttcttcgcattgttttgctcttttcttatccgaagtcttcttatagccactcttcatcttcaaaaatgaagtcgccttatctgaagattcctcttcctcttctaaattgatcaatctgtcttctgctgctgccgcttctctttctaaacgccgtttctcggcagacttttcccactcttcttttgaagcccgcacattcttaaccatctttttaaagaaagaaacaaaagatctttgtgtcagcaaaatacatgcgagcaaaaatacacagataagaacaaccatcgctcctgctgttccaaatccctctcttaataaaagcgcaactccgcccccgataattcctcctgttgcatgattattaatcgccacagaaaataaatcatgcactgtcactgtcgtatctttatataacaactgcgatacggccgatacttccatcaaaatgacaaatcccgcaccacacttcttcattgccaacgtactgtaatcattggcaaccaaaattgttataccaaggaagaaaaataccggcataacaaactgggcacagccaaaaataccaaaaaagaagctggccagccattttccaatcaatccacaatgtccaaaattactaaacatcataagaacgaccagaccaaaagcaacaaccaacgtaatctcactgctcatcggaattccttctgccttttgggatgcgttttttctggttcccgaagtatgatttttcgctgtagtttttctggtcacattattctttgttgtgactttctttgttgtttttcgttttatcttattctcgtttgttttattacttgccatacataacacctttattttctaagtttgatatctttatcatcatatcacaaataccgtcagaaaaaaagatgcgttcttaaaataaataacacattttttcttctatcattttttctcctgtcttttcttcctgcttctttcaatctcctgatgcagccagaaaagcgcttcagaaacaccaccaacttcatcaataattccttcttccaccgccatttttcctacaagaattgttcctaaatcttttaccatcatcccctgacgtatcatcattctttccagcctgcttttcgcaactcctgtatgtgcttctacaaatgtaacaatcctatcctgtatcagccgaaagtattcaaatgtctgcggcgcaccaataatcgtaccattcagtcgtactggatgcagaatcatcgttgccgtcggtgcaataaatgttcgatctgccgctactgaaagaggtactccaatagaatgactatctccaatcacaagagaaaccgtcggttttttgatagatgcaatcatttctgctgccgcaaggccacaggaacaatcgcctcccaccgtattaatcaggagaaataatccatctatctcctgattatcctgtacttgggtaagaagcggtaataaatgttcatattttgttgtctttattctgtctgatgataaatgatgcccttctatctcaccgataacagataaaaataaaatatgttgccccgtcccgttattctccagtaatacttctccaagttctagtaaactttctaattgcgtattcatgagcatcctcctctatattttcatgtgcttccgaaatcttttacacctgtagcatgtttcaaacacgctctaatcttataaaacgatttttccgaaagcagctttccctttagcatgctcattttgaaagaaaaaacacctaagaattatatccttttttaataattcctgggtgttttatctatttttaatcctgtgtgaaaatattctttagagcgtgtttgaaaaatgctctagacttccgtttgtctctaaagcttttattcctttagaataaatctcctgcagctttccatctttttgcataaaaagccgatgttcattttgaaaacgatggcttgttttaagaaccttccaacttttaaatgtttctttgtgctgcttataatattccttatctgcaacgagtatctgtgtattaccagcctcaatatctgaaagtgcttcttttacagacaaaaatggaactgcccgccccttataacgatttgcaagatatttcgcaaatacttcctcttctgtatcggcaggtgctgcaatactgttatcttttatttgttttaaagtcgaaatgttagaactttttggcgctaaaacacaaatattagatgtgtagaatgacttacttgccaaaatattcttacctgaggatgcatttgtcgctccgataaagccatctatagacttcttagaaagattttcattataagaagatgcatctacaggaacaaatttataagtaaatggttcttcttttgccattgctgcaacaaaatctgcatagtatccttttggcagtccatcttcttcgtaataatatggtgcattatcatctatcacgccgatataataatctacctttgtctctgcctcttgcttagtgccccctaatgtgcatcctgtcagaagaaataagaatactaacagcatgatactaacaggtatcctcttcttttttcgcatggtgttcctccctgtctgctttccgatttacaatcctaactctctacgataaattgcgatgcggttttcaatttcctgcaattcctgctcaatttccctgatccgtgccttacctttttccatatcaattgctgtttccttcacaacttttgtaatgtaacggggaagattaagattatattcatttttttctatctcatccctctccacacaggcacacaatccaggaattgtctttctctcactccaaagctgatctatagtatctatctgttccttatcaagactttctatctccgagcagtcaaaaaacaagatatcttttcgttctcgattcatctggaaaaataaaattgcctcggcctgccctatagagtgaaatatggaatccggaagcagcattattgtatcaagacaattcaattcttccacaagatacttacgaatttgcgcttctcttccttcccggtaaagcatcgcaccaggaaaaactgccgccaaaaatccattctcttttaaacaagaaattgctgtcagtaaaaatggaaattcccccttcgttccagcataaaactgttcttttccaagagaaagttttggtgaagctatatattctcctgcttctacaccttccggcataaaaataaggatattatctgctccatctggcaaatctctgattgctctccagtcctttttcatgaaaagatgtagggaatctaatggaattcctctcatataacatacaatcgtaaaaatatcaatatattcctgttcctttgtatagccataaatctctatatttttttctgtacttataatggaagatgccaaaataccatactgaaattctggaaataaaactttacattttccttttttcttatgaaatcgcctgcaaaaaaacttatgatacagttcgcttagttcttccgatatataggtatctttttttaactttgcaaattctgcaatcagcaaaataaatagttttggatactgcctgagcaattcttctttacaatcccagccatcaattttttttagaaatttacgaaaaaatcttgcataacttttttgtttttctaaagaatgtactctttcaaggcttttataaaatgaaaattctgtaagttgaaaatctttattcaaaagatgtaaaaaagaggaagcggattccataaattttaaaaaggaagctacctgaagctttccacgtattgccatcttcactaattcacccggcttataagcctcttctagtgagtcaccatgttttaaacaaagatactgataaaataagaggaacacacaactatctctgtattcctcaaatgtcagacccggatgactctcacttaaaattgacaaaaattcatattgtaactgtttttcgtccatccgtttccccttttataatttttctaaatggtgcatcatttcttctgtcagaactgcctcttctaaacgcatcttttccataagaagtacttttttccgcttctgataatagtacagcttaccaattgacatctgcgttgataaattcggacactcaatcatcaattgacgaatcatgtgtacagataataccttaactgaagagtttccctgaatggcaatcatccgttgcctttttatctctggatgttcattaaaataccatgcaaagtaatagggatccattatcccattctgaaattctatcgaaacaaaattggatgggataatcttgccctcatgctgtttctccagtacggcagcacgatggaaggaggtcagtccgattacgatgctatgctcttttgccagatttaaattcttcaccttttttttatcaaccaaagccgtaggaacttcataatcccacactccattttcctcgtcaattaactgactaatcgtaagaatgggatactctgctccctcacttaatatctttggctttatcctattcagtacaacaccatgcgtaatctggctgatttgttctaaaaggaactccaacctcactgccccctcgtaaaaataatttatttgataatctcgcgaagtgccagattaattcttcccatcttatcaatttcaagaacttttacttttactttatcaccgatattaacaacatcttctactttctctactctttctttagaaagtttagaaatgtgaatcaggccatccttatttggagctaactgtacaaatgcaccgaagttcataatacgaacaacttctccctcataaatcttgcctgcttctacaggttctacgataagacgaatgatttccattgctctgtcgatcattacctgatctacaccacagatatctactcttccctcatcattaatatcaatcttaacgcctgtctcatcaatgattgcgttgattgtctttccctgttttccgataatctcgctgatcttatctggatctacatgcatctgcataatctttggagcatattctccaacgtggtctctcggtgtagagattactggttccataacatcagtaaggatatgttcacgagcttcttttgtacgagaaattgcctcacggataatatctggtgttaaaccgtgaatcttgatatccatctgaattgctgtaataccatcatgtgtaccggcaaccttaaagtccatgtctccgaagaaatcctcaaggccctgaatatctgttaatacgatgtaatcatcatcgctgtctcctgttacaagacctgtagaaatacctgcaactggtttcttaataggtacacctgctgccattaaagataaagtagatgcacagatacttgcctgagaagtagaaccgttagattctaatgtttcagaaacagtacgaattgcatatgggaactcgtcctcacttggaagtactggaactaaagctctctctgctaatgccccatgaccgatctcacgacgtcccgggccacggctaggctttgtctcacctacggagtagcttgggaaattgtagtgatgcatatatctcttagaagttacatttgcatcaaggccatcaatcttctgtgcttcagataatggagctaaagttgtaattgtcatgatctgagtctgtccacgagtaaacatacctgaaccatgtactctaggtaaaagatcaatctctgcagctaatggacgaatctcgttaatagcacggccatctggacgcttatggtcttttaagatcatcttacgaaccgtctttttctggaacttgtatactgcatcatcaattaatggaagccagtcttcgtgttcttctgcgtaacgttcttctaacttctctttaatctgacggatattctcctcacgaacctgctttacatctgtaaatactgcctcttccatagcttctggagtgatgaaatctaccatatcattccataaatcttctggagtgtctacatgttcgtattcatgtttctcttttccgcattcttctacgatacgatcgataaacttaattacttccttatttacttcatgtgccttgaagatagcttcaatcatcttatcttctggaacttcattcgcaccagcttcaatcatgattactttctctgctgtagaagcaactgtaagtgcaagatcagaaactaactgctggtctgctgtagggtttacgataaattctccatcaataagaccgattcttgttccggcgataggaccatcaaatggaatatcagaaatagatgttgcaacagaagcgccaagcattgctgttacttctggagaacaatcagggtctactgccataactaagttattcagagttacatcatttctgtaatctttagggaataatggacgcattggacggtcaataacacgggatgtaagaactgcatgttcagatgccttaccctctctcttattaaatcctccaggaatcttacctactgcgtacatcttctcctcaaattcaacactaagagggaagaaatcaattccttctcttggcttctctgaagctgttgctgtggataaaaccactgtatcaccatagcgcataagtgcggcaccattggcctgcgctgccacttttccgatttcaactgtcagtgttcttcctgccagttccatagaaaactgttttaccattacttaaacctcctgaaaaaatatatttatctaatgagggaaggtttccgaaaccactgaaaaaagcactgtttcctccaatgctcttttcagaagtctcgggcacatccttcccatagtcataaattatgacctaatctttactattctatcacaggataaaaaaaactgcaatagttgaggttactatttaattcattaagagagagacgcccaggaagagaaccgatagcctatatttgtgtctttagtcgctacgagaaatcgtcttctatgaaaaggccgacattaaaagttattgattttgactcagttgtacaaaacacaaagtcgtcaaaatcaataattttaatgtcggccttttctaacattttactacagtctcgtagctccgaggccacaaatataggctatcagttctcttcccgggctgtctttggctggattttgtttgaattaagatagtggttgcgaggatttgggtgagcgggcagaagttttctgcttgctctgaaaatattgtagatagatattttttatcccagtttgattcgtttatcttttattgtaagctgctaacagattattcctaaactattattactgattggatactacactggatttcaagtaaatttggtgcaattattatattattttccgcaatatttataaaatcaaattttaaatgccgattttttcattttactattacatataggcaggtcaaatcatattccatattcccagtcattctcgagtaagcagaagacatcagcttctgtccccaaatctcctcccctgtttaattcatcttctccagccacatcacagaagccattgctcccaataaggcatatttgtggtctcggagcaagtgttggatgcgagcgaataaagcgaacattcaacacgccgcgactaaaatcacaaatatgccttattgggagcaatggcttcgtctgttgtttcttaatgaattaaatagtaattatgtaagatgtttcggtgttcctgcctgtgcgtaaatggatattttttcgcgttctctcttacgaattctttctgcacattccttaatcttatggcagatccacatataagcagttgttccttctctgtagtcagcttctgcatacatattaattcgtccgtccaccctcatctgttccacctgccgcatggcttccatatctccatgtggatagatggcaaaggtggcaccctgatttttattgacaagagaaaaggctggaatatcacttggtccgtctgcgacataaatcatgttacgaaaaggaactcttctaagctcttctggcatcttcgtatttacttcaactccttcatggcggttaactcctttattgatttcaaacaaagctctcgttttactggtattatcaatcgtatatccaatctcacttatgattttttctccattttctatctcttcttctatcaattcgcagccccagattccttttacatactgtacaactacagagccttttatcacctggctgagtccggtacttacgatataatgttctactttaatatcatattcctgataaatagaatcttcttcaattaactttctcgtctcttcaaaaatttcgggaaccccttcataaaaatgaagattctttccaaaatcataaagcatcgcattattcagtcctttaaagattccctttttggcataatgaataaaatgattgagataaatcgtatcaggattcactcgaaccccctgctctactctgtatttttccggcagagaattaacttctctccaaaatacagaagaatccactccataatgttcaaaaatcggttcttccatatatccattaactaaagtcttatcaaaatcccagacaactgcgataatatttgccattcggttctcctttctgctgaacttgctataattactcttctaaaatatagtatagcacaaaattctgatttgtgaggctgcaaaacagacgaactcctgaagctaaataaagcatatttgtgactttagtcgcagcggtttgaatgttcgcttacagcgctcacatccaaaccttgctccgaggccacaaatatgctttatttagcttcaggagttctgtgcgttgacagctcagaaaaccagttggaggattttggggattccccgaaaggctgtgattttatgagaaaatacaatgaatctataatagtatattaaaaagataatatttaaattcgatttttcaaagtttttatagcggatgtttatgtttactcctgcatcaacaaatcagtgaaaaaatttgagaaagtgaatcaaagtaatatctttttataccatattatagagaagctgatttttttacaaattcataatattctggagaatccccaaatctctaacatgaattctgattttgtaccaatatccacagtcagccagaaaagagagcctatcccctatatttgcggcctcggagcaaagtttggatacgagcgtgtgtaagcgagtattcaaaccgccgcgactaaagtcacaaatataggggataggctctcttttctggcgtctgtttcacagccttacaaatcagaattcaaagtttcattcatactgcctgttctatatcctgttaagtccattgtaacgtaagtaaatccatattctttgaaagatttcgtaatcagatttcggttggtttcttccactaatttcggaaattcttctggcaagatttcaattcgtgcgattgttccgtggattcttactcgcacctgatggaatcccatatcgaggagtaactgttctgccttgtctaccattattaatttttcttcggaaatagtttctccatatacaaaacgcgaggaaaggcaggcaaatgattgtttgttccaagttggcagtcctaaatcttttgagaggacacgaatatcagctttatttaatttgctggctcttaatggacttttaatccctaattctgcgactgcctgtaagcctggtctgtaatcgccgttatcatcaaagttagaaccttctgcgattgccactacatgctcctcttttgctattttccatattttttcgaagagttcttttttgcagagataacagcgattctttggattatgtcggaagccttcaatgtctaattcttcggattctacgactaaatgacggataccttctttttcacagaaagcttttgcttcttttaattctcgttctggaaaagaacaggattttgcggtaactgcaatacatttttctcctaatgtatcatgtgcaactttcagtaaaaatgtagagtctactcctccgaagaaagctaccgcaacactaccgagttcttttaaataattctctaaatcttctttctttttattctgttctactgatgccataataaaatcctccaaatgttatattgtctgcatagtacattttattcctactttgtcaataggtttatatgttgctatggattctatttttcacttcctgtaacggaatattattcatgacatcctcttactactttctatgtatgaaaaatagtgctataatttaagaaaatctttatttttcagcatagatcatatagtaaatctgccaaaataaatttttaatctggctctcacttgattctaactgtgaaattattaaaagatttttaaacctattataaaaccagaactaaaaaggagattttgacatggattacagacgttttaaagataccatttatctccgccttgaccccggcgaagaaattatagaacagattgaaaaagtagcgaaaaaagaaaatattcagctcgcacagattaacggattaggagcacttaatgactttactaccggtgtttttgacacggtagaaaaaaagttccaccctattcactttgagggagcttatgaaattgtttccttgacaggaactgtcacaaaacaggacggcgaagtatatcttcatcttcatatggctgccggggacaaagatggacatgtgtttggtgggcatttaagtatggcctatgtcagtgctacagctgaaatccagattcagattagcgatggagtaattgacagaaaatacgataaaaaaatcggcctcaatttgttcgattttactatttaattcattagacaaagccattgtcccgaataagacatatttatgatttattcaggacaatggctttgtctgtagcctattaaaccaaactttattcttatatatgttttgtgtgttattgtttattcgtgtgtgttaacttatgtggttttaatgtgtgttgttgtttatttatatttctttatgtttacgttcgtattattcgccaaaaacagctttgtaatcagcctggaattttacaataccctgatctgttaatggatgttttgtcatctgctcaattacagagtaaggaactgttgcaatatcagcaccagctaaagcacagtctgttacatggataggatttcttacagaagctgcgatgatttctgtatcgtatgcataaatgtcaaaaatctcagcaatctgtctgattaaatcaattcctggctggctgatatcatctaatcttccgaggaatggagaaacatatgtagcacctgcgttagcagcaaggattgcctggtttgcagagaagattaatgtaacatttgtcttaatcccttctttagaaagaacttttacagcctttaatccttctactgtcataggaattttaacaaccatgtttggatggatagaagcgatttcacggccttctttgatcatgccttctgcgtctgttgtcgtagctttcacttcgccactgattggtccatctacgatagaagtgatttctttaattacttctgtaaagtctcttccctcttttgcaattaaggatggatttgttgttacaccacagattactccaagatcattagcctttttaatgtctgctacattagcagtatccacaaaaaatttcatttgtttaacctccatttgtttttgctttgtttgatgatatgaatataacacattttaaaaggaaatgcaagcttaaaagcaagaaaaaataagtaaaaataagtaaacaaagcttttttcttgtttttatcctcgaatcttaactttttctctcttttcactggaataatttcacgattcagggtataatgaaacaacaatatattgggaggaacctactatgatgcaattagaacgccagaaaaagattctggattatctgaataagaatagaaaagcaactacaaaggaattaagccagcttcttgatgtatccaccacaacaatccgtactgacctaaaccagatggatagggaaaatcttattacaaaaacacatggcggtgccgtatataatgatagaagccttgataacattgaattaacggggagagcatatttctttgatgaaagggctttggagaatcaaaaggaaaaagaagcaatcgcaaataaagcgataaaattaataaaaaatcatatgtgtatttacttagatgccagctctacctgctacacacttggaatgaagctctctggttttaccaaacttactgtcattacaaatggaatcaatcttgctatggcattaaaagatattcccggtatcactgttattttaaccggaggaatcgtaacttccgtatcctcctctatcgaaggattactcggggaagatttattgaaaaaaattcatacagatatcgcatttgtatctgcccgtggtttttctgtagaaaatggtctcactgacttcagtatctatgaagcggacttaaaacgaagatgtgtaaaatcctctgctaagaccattgcgttaatcgatcatacgaagtttaacacaacttctatttctagttacgcatcattagatgacttgaatatggtcattactgactttggcctgtcagaaaatacaaaagatatttatgaaaaagctggagtgaatctggttattgccaaagaaatgaactaatcaaataggaatttgccgcaggcaaagagacgcccccaaagagaatctgacccctatatttgtgactttagtcgcggcggtttgaatgctcgctttaagcgctcgcatccaaaccttgctccaaggccacaaatataggagccagactctcttcaggggctgtgctttggctgtgtggggatacaaagaggtcaaatgccacatcattttcccactattgataaccacatcagccttcgaccatgttggttccacataaaaataacacttcctaaaattgaggagcgtctattttctcctacaaatcagaactttcatcaaactcgtaatcatttcctggaaggataatgtttaagagaatccctgcgatggctgcaatggataatgcagtaagtgtgatagatgttcctgctactgtgaaagttaatccatcaccaaatccaagtccacacacaaagataacacctgtgataatcagatttcttgactttgtgaggtctactttattctcgacaacattacgaactccgatagcggaaatcataccgtaaagcataaagctgacaccaccaataatggcagatggcatcgtactgataatcgcagatacctttggaataaagctgatgataattgcaaggcaggctgcaatacggataactaatggatcatatacatgacttaactctaatacaccagtattttccccataagttgtattcgcaggaccaccgatcaaaccagctaatgcagttgctacaccatctccaagaagggttctgtgaagtcccggatctgctaaaaagtttttatttactgttgcagaaatggcagacatatctccaacgtgttccatcattgttgcgattgctattggagccataacaagaattgccgtcacatcaaacttacaaatctggaatggaggaagtcctacaaaaccagaagaagctacagatgagaaattcaaaatggcagaaccatctggattggtaaagccggctgcattcataatcagcgcaacgatataagaaatcacaactcccataaggattgggataattttaaacatacccttgccccatatattaaaggcgataattactgccaatgccacaaatgctaaaaaccagtttgttgaagcattggaaattgcagaagatgcgagactaagaccaatacagatgataaccggacctgttacaactggtggtaaatatctcataacacgcttaataccaactaagcagataataagtgacattactacatataaaagaccggcaaccactacaccaccacaggcataagcagccttttcatttgcactcattcctgcataaattcccgtattcaaatgcgctactgtagaaaatccacctaagaacgcaaaagaagaaccgaggaatgccggaaccttcattcttgcacatacatggaataataatgttccaaatcctgcacaaaacagtgttaccgctaccgtaagtccccttgtcggatgttctccacaggcatccataaaataactattgaccagaatcggtactaaaatcgtagcaccaaacatcgcgaacatatgctgcacaccaagaatcagcatcttcggcaggcccagcttcttcgcatcacgaattacttgatttgattcattcataaactttccttatcctctcttgtttttctctgctattatacggggataaaatgagaaaaacaagagggaatttatttcacattctttcctaatgcttctaattttttcagaatctcttcgtcttttgcaatatcatccttacccattgcactataagactcatggaacaatacattccatgacagatactctgccatacactcaaactgtttccaaatcaactcatactgcacattatctactggcgcaccacccacaacaatgagtcctacctttttctctttaatctgcattccacggcaatagcatttatcaataatcaactttaactgagccgtcattccccaccagtaaactggagtagtaaaaagaatcatatctgctgccgcaatcttgtcaatcgtttcatttgtatcatccttgtccacacagcctttgtgacactggcaagctccacagcccttacaaggagcaatatgtaacttttccggatgaattacttcgatctggttaccctcagatgccccttttataaaagtattgattgccgttaatgtatttccttttcttgcacttccgtcaataattacaattctcatgatgtatacctctttcttttaaaatccgtttttctatttttctaatacctttaaaattagccgctcaaacgattgtgcaaatctcacatcgtcctcttctgtccgttttctcggtcccttcagatgatttttatgagaacttcttctcgccttcttattcagatgccgttccatcagcatctggtcaatattgtcattcgtgtaccatttgcccgactgatgaatcgcatacgcaccctttccgagtgccatcgccgccactccataatcctgcgaaacgacaatatccctcttatgacagatgctgattaatttataatctaccgcatctgctcctgctccgacaacaattacttcactgtaatccgaatacaaaatatgattcgtatcacatagtaaggtaactggaaggttatatttctttgctgttttttctactatgccgactactgggcaggcatcggcgtctatgaatatgtgcatggtaaaactccgttggtgaagtactcgacaattgaattaccgagaattcccgcttaattccctaaaatttataaatagtcatattatctacttcttttcttatctgcctgcaaaatgcttcagtgtatcttgtaaatcctcactgaaatcttccaaatcttcaaaagttatcgctccctcattcagcaatgataacatagtgacatcctcccccacctgtaggacgccactgaaaaagtcctttttacgtgtaaatcaatacaaaataaaatatgtttgttggtttcacaatactatatattgcatgtaaaattagtttttcagtgtcgtcctgtagaggtgggggcttcccaacctcggcaagtttggttctcgttcgataacacttctgtgctaagcataagcgagctatccccgtgtgtcccacggttgtgttatattgtgtcaaggtcatgcatttaccagccgtattccctcatttctgatatttaccgccgcatttacatctctgtcatgatgggttccacactgcggacaatcccattctcttattgcaagattttttgtttttgcatttttgtaaccacaaacagaacaggtctggctgcttgcaaaaaatctatccactttcacaagtttcttgccctgctcctccagtttgtatctcaaaaatgttgtgaacattccccagccgttatccgaaacagatttcccaaaatttagtgaccgcgacatcgctttcatatctaaatcttctatacatacgcaatcataagcattggttatctgccttgactgcttatgcagaaagtcttttcgctgattggaaaccttttcgtgaagttttgccactttaatcctctgcttattgcgattgtttgaacctttctgcattctggaaagcttacgttgttctctcgctaattttttctctgcattcctgtaataccttggataggcaggttccttaccattgctgtcacgatataattcatgcatggaaaaatctaaacctaaaaacttttgcagttccttttcctgtacttgatcttcatactcaaaaagaatacttgcatagtattttccacttggtgtctgacttactgttacagatttcagtctgtattcacctggaacagacctgtgctgttttaaccgaacttgcccaatcttaggtaatctcaaatatccattagacagagttatgttcccattgatgcagaccgtggaatagctgtttttattccgcttttttgatttgaaccttggaaaacctgttttcggctgtttgaaaaagttctgaaatgccatatcaaggtgcctgagcgattgttgtaatgcgatactatctgcttcctttaaaaatccgtattcttcttttttcttcattgcagccatttcttttgcgcaaatggtatatgttacgtttgtcttgttctcctcatactgccggatttttctatcaagccaatgattgtataccattctcacacagccaaaagtcctagcaaacaaaatcctctgttcatcattgggatatattctgaatttatatgctctgtttgccaccatgccacttccttttcctcaaaaaacctcctgcgatacttgaacacaagcgcaagatgatagtatagtaagaatactaaatgtgcattattatctcaattttttattatccgactaaagatactatactataatcaggatgctctatcaagtaggtatagacgcaattcatctcccaccttagaggtcggagtcttcttgctgtaaaaggataaagactgatatcctgcactcagcatagtaatcggcattaccatattattctcctgatatactatctcttcaaattgactagaataatatatttctggtgcattatctaatccatttattttcttcataaagcaagaaacgataaacttaaatgcctcatattccttaattggcattttcttctgaatccatatcaataaaagctgtgatctcggctggtataccataagatatttctgttgaagcatcacccttcccacttgttttaaaatgaatatcattctgactgattccttttgttgaaacactagaaatacctttaaaaattccagatattgccactccaattgcttctaacatagaacttttacctgtgccattatcaccaattaggagatttactcctggtgtgaaactcagttccatgtctgtgatggctttgaaatttttgactgttactttatttagatacattttttcacctcccaattaaatgaagccatcttgacttgtgctgtaaaatttctcatttaattaatttatgttctctagcaagtccttcatttaaaactgccacttcaatatcccatattttacgaatttgaagtaatctagcttttaactctgccattggaccaaccagccacgtaatatcctctgcattttttacaacaagaataaattttaatttagcctctttcatcgcatttatagaatttaaagaatcccctacctctgaagaatcttgaaatctgcttagaattgtagccaaataaatttgtagagatgcgataaacttttccgttatagatgaataatactcttcaaatttatcttgtttttctttagactcatatctatttgctgcattaggacacgttttctttgcctccaaaaatacaatactattttcattatattttaaaacaaattctactgtttttattccagaaccaagacttttatagattttagaatcctctatatgaaataaatttttctcatcaaattctccaaaatccatttcagactctcttattattttcactttaatgccaccccaatttcttctctataaagttggcggaaagtatccataattgtgttatgctctaataattcaaactccttagctatctcacactgtacctgattcttttcatctttatacaaagaaatatattgaacatcgctatccttctctcgctttacctcaatatatttagacagaaaataatcatgagtagagacaaatatttgtactccttctttttctaacataattaataactctgccaatactgggatatacttaggattaatatttgcttctggttcatcccaaaacaacacagaccctttttctaaagtaccatttttaattaactgccataaaagtgctatcttccgaattccttctgcaactaaattaaactctaatttagcctgcgtccctggttttaaatagaatctatcatcttgaactgttacttttccattactgattttctgtaaaatctttaaatatttttttcttgctacagaatctacatctgtggaaatgtcaatttttgctgctgcaataatatctaggtatgtgtcatcaaattctacatttcccatctttactgctgcatccagattccatgcgttcgataaaatctcctttgcaggaatgaatacactagtcgtacctgacatttgtttttcccatttttcttctgatttaacttctgcatcccactttttagtttttgtcgaaaatgacatacctatctgggctatatcagattctactagaaccctcgccgtattttccccattcttattcctatttactaagcgtccaataccagactggtctggacgaaaaagcatcgttgttttttgagaaaatgagacatcatgcttacgtgactgacatgctgcatatgctaacttcataacatgtgtctttcccattccattttctccgaccagtatatttaaacctttgctaaaaggaattgttatgtcttcaaatactgtaaagttttcaattttgattcttgttaatggcattttcatcctccataagctaacctcacttttttaatagatatttaattgtctttctccttataccttcttctataataatccattgtcctatattccacaacatctttcatttgctttataaacacaggattgtctagtacctctttcatctcgtctttaagagccaatgccgctctttcttttttaacaaaaaagcctttccctgactccaacaaatagtgcactggcatttttaaaatttttttcaaatggtctttatctgaaattgcaagatatttttcataggtaagttctttgtcaaggtctttccaattcgttcttgtagaaaaaaatgccttccagcttgccagaagctgttcttctgaaatttcctgacgcacatttccttcattataaaatgccctaagtacaggcatcttataaacttttgacatactcgtattttctagcgggtttataaattctctgccattttcattctggtaaaatacttcttcatttgctgtaagttcttttaagcttctctgataacttagatatcttttaaatggattctcttttgcatgtgtaattgccaattcataaatatcatcttccatatagataaacagctccattcgtgacggtgttcttcccaacaattccttaactctaaaatattctttttgaatttgctcacttattttcaggttcttcttgtccatttcggcaaataagtcaattatcttcatatcgaaatcaataagacaatcatccggaaaatcagattgatttaaagaatagtagttattcttttctgaaagattttttcctgttaacaaaaagcgggttcgtcctgctttttcataattaccgataaaatccaatacattgagatattcttttcctttactttttcgaagtcctctgccaagctgttgtaaaaatacaattggagattctgttggtcgtaaaaataagaccatatctactgacggtacatctacccccccccgcagaaacactatattttgtattaaatgtgcataattatagtacatttagcattcagtgggacatcgccctatctttttggcaaaagtaaatatgaaaatcctttatttataggctttctccgacttttgcactaatgtcactatccctctttgcattagtcaaacaaacgaaataggggtatctataccttcgtaattatattcttagccgcgctcataattttaggaccattcttttttgccacaattacgcatgttgtgagtgcacctaaaataactcttctcacatgcttggcagcattatccattttcttatgatcatctctattcagctttttcttttgaaacttctccgccatctgacaacacctccaataatttatcaccagtaacttcaagtgcaacataattatatgatttgccactttctacacattgtttcttttcgatttccacatactgtgaagcatgattatagaacatatcatcaagatcaacgcccctgtgtgccaactctatagacttaagtttaccaaaatctatactatcaaaaaaagatatgccatcttcaaatatctgttcaacagcagccatttcacctttatatgcgtatgctcctgcaatcatctttgtagcttgcaaatacatttcgtagcattcctggatattttcaatttcatcatcctttttgttctgataattattatgagccaatgtatttaagaaaagcaccactctactctctggtaaaggttcaaaatcctctattcggcgaaccattgctttaccaatctgctcccggcctaatagtaaattgttgattccaaaccatatttgcttattcctatcattttcatcttgtagtgtcaaagcaagcattatttcttttcttcccgcttcaataaatgctactctatcatcttgctgtcctcgttcaagcattttaactatctgataagtttcttctactctttctgacaactgggccatttgctgttgcatacatatattatgataactattgcaaatgtcttggaaaggattaccttctataaattcttgctgcttaattggtaagtcatccacaaatctatactgtccattttcagcctttctcattaatatgggccattctattccagttgttttattttgattaataaaatactcacctgcttcatattgcttttgatactgtgctggtatttgaacaacatattcgacacccttttctattgtagatgcaatttctgcgatgttaacatattgtgccaatctatcaacggcgccagcaaaatcaatatttgtcattccttcatgaattttaagagttttattacctttactatctaaaacaatctctccttctaacttttctgtttcttcagttaaaataagctccttatttacaatcatttcactgcgaattttctctatcaatgttaaattagccggcaaccattgaactgaatctaactcatttttccttaaccacttagctgactctgcctccttcagtaccagcttcccagttattgtttcacaccaaaagcattccattgaaaggcggaaattaggataatcgcattcgatggtatcaatcagatcatatacttcaatttttatatccaatttttcttcaattccacgttttaatgcctgttccgatgtttccccttcttctatttttccacctgggaattcccattgacctttaaattctccgtagccccttgccgtagcaaatattttatgcttttcttttaccgaatcacaaataactgcggcaacaactctaataatcttcatttactgcctctccttaagctctttcaagcgcatgagccatttcctgacagttccagattttatcatttccataatagcaccatcacaaaatctctcgctttgcaccatacccataaataatgccataatactttgtgcatccatatgggaaacatcggcattttccattgaaccttgtccccattctagacctcgttctttaaaaagttcttcatattttgtcaactcatattctggattttcatgctcaaactcataaactacttctgtatatattggatatggaaagtgtatagggtcatcttccgttcctttgtgtcctttatctattatccattctccaacactgttagtttccaatagttctaaaagccctatgaacttatcaaattttgtatcaaccattctattcatctgctttcaattttattaacatcacaaaatgtatatttacggttgttccatatccacttttaaaccggattgaataatgacttctcacttcaatttattgttaatcaataattattttaacctacggccaaacaaataaacgctccctttctttattcatgagtattttgtaactcctcgaacatagcatgagccaaagcacccatgattgcacggtattttcccgcatcctcaaacaattttgtgtatgtttctgtactttctatgtacgcttcttgtgcagcatcatcaaaaagttgtgggaaaatattcttttcaaaaatctgccgtccatctgtctttgctgcttttaccaacctcttgttattttttaatttctggtgaagtgtcgtaattacaactttatccccttcagtaaaatttcccatatactgttcgtttatcttttcaataactttttctagtggactaagtgtttctaccatttttacaggtttctttaatttagcaggttcataactgcccttttcttctttcgtaagctcaatagaaccttcaaatgttttttcaaggttataatactcaagctttactctatctgcaagttcaaaaggaactttggggtctgctggaataactttagccagataagagcagaaaacaaattcttcatgtaaaggcttatcaaacatacgagcaatttgagtaatatagctataccatttaacaaatgttctgcaaagtttacggaactggtatctctgttcctgattcaatgcgttatacttctgctgaatcggtaacaatgcatttgtcaccgctgcctgaatcttattcgccttacgtttatcttcatcgaaataaattttatttactttttcgatgtcagtatcatcatagattttaaaagcacgcaacatcttctgtgtcttgtaaatcaaatcagtattgatttcctgagccaatgatgtttcctgatagaacggctgaaacgctttcaaaatatcttcttttgtattcacaaaatcaatgataaatgtatcctgtttatctggatatgtacggttcaatctgctcagtgtctgaaccgcttttacaccacgtaatttcttatcaacaatcattgtatgaagtaatggttcatcaaatccggtctgatatttctcagctacaatcagaatatttccctcatcatggaatacctgttttgtctgtgattcattcacaccattcagcttgctttctgtccattcaatctctttctggtcacctgggtctttgatagaaccagagaacgcagccaaaatttccacatcatgataactatttgattccaaatagttcttaatctcatgatagtaacgaaccgcagcaagtctcgatgctgttacaaccatcatctttcctttccctttaattttctgcttcgttatattacggaatgtttcaacaataatcgctgatttctgctgaatgttatacggatgcagttcttcgtatctcttgattgtcttcagtgcttttgactgcggaacatctggattatcctttgtgttcttcgcaatctgatagcaagttttatatgttgtatagttttgaagaacatccagaataaatccttcttcgattgcctgacgcatcgaatatacatggaatggatgataagaaccatcattccattctgtaccgaacatctctaatgtcgcaccctttggtgttgctgtaaacgcaaagaatgaaagattcttatgttttccatgagcaatcatttcacgtaccagacggtcattgtcatctaacaattcattctcaacttttccttccaattccgcatactctttcagagcatctgacacatccgcaagtgcagccttcaatttcattgccgaagaaccagtctgtgaagaatgtgcttcatccacgataatcgcaaaccgcttatctgttgtatcatctacttcttcataaatgaccgggaatttctgcaatgttgttacaatgattctttttccagcattcaaagcatcctttaaatccttagaagatttcttttcatcgattgcacatacactaccaagtgtatggtcaaatccagtgattgtttcttgtaactgtgcatccagattgcgtctgtcagttacgataacaaccgatgtaaatataggttcattatcatcattatgcaaggatgccaaacgatacgctgtccatgcaatagaatttgactttcctgaacctgctgagtgctgaatcagataattatttcctgaaccattctcacgcacatcagcaatcagcttacgtactacatccagctgatgaaatctagggaaaatcagacgcttctttgtgacattctttccatctttcttttcggtcttcacctcaaagctgatgaacttctggataatatccagcaaactatctttctgtaatacgttttcccagatataagatgtcacataattatcatcttctgcctgcggattacctgcaccaccgtcatttccggcaccattggaaccctgattgaatggcaagaaatatgtatctgtaccttttaactcagtagtcatccatgcttcgtaaaggtctactgcaaaatacgccagaatacgatgattcagccaaaatgcaggttccctctggtcacggtcatactgccactgcaattttgcattgtccactgtctgacctgtcagctgattttttaattcaatcgcaaccactggaataccattaattgcaagcatcatatcaactgaattgttgttctgctctgaataatgccactgtctgatacactgacacacattctgctcatatctttttacagcaacatcattcagagtggattcaggcttgaaatagcaaaccttaaaatccattccacgatgtttaaatccatgtcgcatgacagacagcaagccatccatctgtacggcgtcttcaaaacatttataaaacttcttgtatgggtcagagttacactgtttttcaaaacgctgccacataattggctgggttgctttcacaaacccaaccaacgtatgaatatccaacgccataccagaagatgaggtatatccagcatctgttgccttttcatatccaccagcagatgagataagaaaggcttcgatattggattcaaactgtttttcattttcagccataggttataccacctttctttttcctgttaccacttcgtaaatcagtgattttttgtatgcttcaaggtcattgataagagattctttttcagaaatgagggaatcaagttcaaatattttattgtccaaccactttactaattcttcttgaattgtaattgatggatatggcatatatatatttctataattggtctgagtcattcccggtaatgttgtttgagaaatatatttgttataatcaaaacaactagcaacataataaaaatatttaagttcaattttattatttatcgggatagtgttaaatgctgtgtcaacattccagtatttaccctctatataatgaggaatatgtaaggtggctccttttctcccaagtaaaaccgttggcccttctttatattcaccgcatgtcttaaaactttttgctccactcccatatactggaattttcccttctgtcgatgggtttgacccattttcaattttaatgacatattttgttttgatgatttcccaatctaacggaattttaccaatccaatacacaccactgtctttcatctcaacatttttatcaagaccttttgtcactgcttcaaaaattacagactgtttcagttccttatattcataaatacttgcctttgcttctgcaatgatttcatcaatttgggaacaagtcttatccaaataatcggcaatgacctgctgttcggatagtgttggtgctacaatcattatcttcttgaaatcctgatatttaagcgtttttcgtatgccacttcctaatccatgaaaaacttgttgataatcataagattttaacaaataaagcacaaatctaggatttattttattttcatcaggctgtatagctaaatatgcagatgtaataattccgctttcatttacaatagctactctttgtgatacgaaatcataattcaaattcaatccattaatcataatggtattttttctaacgattgtatatgagcttaaagtctcttttaaattattatccacatcaccaacttgctttttgtcaacaatttcaccatacttaaacgaaaaagcatttgtaaatttcaagtccgtgtttttttctttcacctcactaaacactccattagctggaaaaatcgtccacgaacttggaatatctccaatccattcaataccactatctttcatttctgtttcaggcctaattacagtcttcataattatttacctccgaacaaattatgcaattttgccatcaaactcttttcataatattcaatacgtgctgcaatcacatctgatggttcaatttgttggtattcatagaatgttctggtgaatggtatttcatatcccacttttgttttggccttatcaatccaagcttgtggattatatggaataacctcacgttcaaagtaggcatcaatatcttctgctaatggcacattctccgtatcacgtttcgacttatcaactactggtttctttttcttcatgacaatattgccatcttcatccaactgtggtgtttctactacaattttgttatagccaaggtcaatggcatccatgaccttactctttacaatgattgcattatcattttcatctacgccattatatgtctcatctacataagcaccatacgctttaataatcaaatcacgacaagcctttgtaatatctacattctttgaaccaatattcttacgtctagatgaacaacaagcagatgcatcaatcagctgtactttaccctgatgtgttacaggcttattcttcattacaatccagatatatgttgcaataccagtattataaaaagcattgttcggtaactgcacaatcgcatccagccaatcattttcgattaaatatctacgaatttcagaaggaccgctccctgcatcaccattgaataaagaggaaccgttctggataattgccatctgtccatcatcttttaactttgcaagaccgttcagcatgaacagaagctgtccatcaccctttgctggcagtcccggtgcaaatcttccggcagtacctttcttaaattccgctgtgacctctttttcctcacgtttccacggaataccgaacggcggattgctgataatataatcaaacttatatccgctgaacttgtcatcagacaaagtatcaccgaactgcatattgttagggtcaccgccacggataagcatatcagcctttgcaataccgaatgtaaatggattgaactcctgaccgaatacagtaacgtctgcatccgcatccatctgtttcaatctttcttccatacaggtaagcatctgagatgttcccatggtcatatcataaaccgtttttgagattccatcacctgtaaatgctgattcatctccagccacaagaaggtcactcataagataaatgatgtcacgacttgtaaaatgtgctccggcttcttcattgtatgattcagaaaatctacgaacaagattttcaaatatatatcccatatcaacagcactgattttctcaggtgaaaaatcgcccttatctgtacagaaatcagagattacttgatacagaagaccagcttcttccatgtgcttaatctgagaatcaaaatccatacgtgcaagaatatcctgtacattatcagaaaatccatttagatatgccttaaaattatctacgatattttcaggatcagcaatcaatgtcttgaacgtaaatggactcgtattgtaaaattgatagcctgatgatttacgcaagaaaccatcttttacagccaacttttctactttcttgtatgtatcaagaactgcctgatgtgttagcagtaaacaatcatggaaacgcttgattactgtcataggtagaataaccaaaccgtattcatgcggtttgtatgctcctacaaggtcatctgcaacagaccatatgagagctgctgtatcattggaattttttccaacatttgtgattaaatcattactgttcatcttatttatctcctagtatagtattttggtaattttatgaaaattttatcataaaatattagaaaagcccatactttttcaagtatgagcttccaatattttcattgaaccattttttatctttttataaattttgcatttattgtatttttcagtctcatcagatatattgaaaatctgtttaaattatatatgttaaacataatcctgtatctgtatatgaaatatctgtttttctattatacgtatccgtatcagactataattatatttatttttgttacacaccaggaagttattcaaatatcatattcttcttcacaattaatacaaagtgttcctgagccacctcgcatttgttcaggatacttacacccacatgctgcacacacacatccattttcgtttgtaaccatacaactatcacataacgtattcccttcattgtctctttgatttacttcccattcatatcctatttttttccacattcagaacaataatatacatcaaattcagaatcctcatcctcatatccatcctctttaataaatgtttcatgaatctttgcatcctgataatcaaaatcctcattccaattaattgttgtatccacttttcttgtaactgatacatcaactctaccactacactcatgcattcttcctggagaagtaattatatcttctgtattattatctattccccagcaatcatatgacacaccaaacatttttataaaatatgagataatatatgtcgctattccagaatctacatctattctttcataaccattatattcaacttcatccaatttccattcttctactccctcagaaccaatatgtgaaatatccacgtggagaaaacttattcctgaataagcaatttcactccaaattgaatcaaatacttccatatgtacttcttctacaaaagactcatctgtagcattcaaaatcattgatgttgcatctggagcttcaatattaaattccctagcaattgcttgatataaatcatatccaatcataggaattaattttaaactttcaccactattttttatatttttagttttatgtgaaaattctttaatcaattcttttctaaaaaggattgaaccatcatctaatttttcccaccaatcttcttttacatcatctgtaacaaaaataacatttttattattcaatacggcatattcatatgtctcagcccaaacaagtaaatccccatatttactaatgccatctttgtatcctggaggcattttcttcttatatcgatactgaccttcctgacactgtttatatataaacgctgctgaaggagctggcatttttgaaaatttatttaccaaatcaaacactttgtctatttcccaattatttaaaaaatctagattttgatgttctatgaaatataaatcaaatttatcttcaatttctgtaatttttcctattaattcattaaagagcttatctatatctggataaccatctttagataattctctacattgtccctttattttattttctatagtcgaaataagttgacgacatagttcagccgaattctctatagattttaccttttttgcatactcatcttttctgtgcttttcatattcccactgcacattaaatggaatacaaatataatcttttatactgttcaaacattctaagacaaattccgcataatctggggatgaacgatatatcttcaaaagtatgtttgcatctaatacaacaatataatttttattttgaagaagttcttttattgcaatcattggattactctgtctttccttatcattatccataataatccgttctctttccaaacctctttttatttttttatccatgtataacctctttttataatacttctcattcattataagttccatttaatttttcataatataacatgttttttcctcccaaatacttttctcatttgttttcttattggtgatttttcacgttcttttttatatatttaagaaaaattgtaacatatttttccaatttcaccataaaaaacacgcaattccagataatatttatccaaaattgcgtgttatatttttatagaaatctctaagagacccttaacaatctattcagaaacctgtaaaaacccttagaaacctttaaaatatcaaaaatgaattctttatcaataaaataataattttagaaaaattcacatggatacctatttgggaattcccttagagtccttttacatctattctggaaccccccagtattcgttttggaaccctctcggaacctcctagtatctattcggaaccctcttggaaccccctgacctacattttggaaccccctcacggatattttctatctataatccccgacacttccatataactccgcttcccacgaatataatcctcatatgctatttccggatctttgcccttgaatactgtacaaagtccgcacatatcacaatcggcgatgcatggaaatgttttttggatgtattgtcgtctttcttcttctgtagaaacttcaatttctggtggtcgcataattaacttcacctgccttgttatcttaccagcccggtatgacttcggtattcttcgtttaattggcggagttctttttcgccattaatgtatggttcataaaaagcatctaccagcccaccgcctaagttgtcacagccattgcagaagtcacaggctcccccgcactggctgagtccttcctgtacgatacggattcgttcttcttttgttgtctcttttattaatatgcttttgatttccatgtgacatcttcctttctattctatttctaattttacatttattctatagatttactatagattataacacacgcgtctttttttcaccacaaaaagcatccagtcttgaatactttttatatcaagtccgaatgttttctcattttatttttcaaatatctggttcagtacttccccaatatccgccccaacacaaatcgacttttctttgatttctgtcggtgctgccgcttcattcaagttaatgcacgcataagttgcatcatcccagctatccgtcatattccaaaagttatattttataattcccggtgtattatagccggttcctaattctaaaaatactgttttggtgtgcttgtgtctgcgtaaaaattcgctatagcgttcggcggcattatgccagccttcatcttccacaaaggtattatctgcgcgaaggttcatgctcattggtttgccgcatttggggcaaacaggaacaagttctgatggaattgccattttaggaatgattccttctggcagagttaattctttttctgtttttagctgtcgcattggttgcaaatgtaacgtgtttgtgcttttttctattcttgtcccaatcacaaagccctgtgcctcgaccattttcctaatctcttcttcattatcataggtctcctgatggcaaggaacactacattgaaaaaggccgtaatcgccctgtgtataaaaaaggcggtacttatcaaatccagctttttgaaagcaatggtctacattggtagtgagtacaaaataatctttctcttttactaaatcatagagtttttcatataccggttttggggcatccatatatcgattaatataaatgtatctgctccagtatgcccagtgttcttcgaagctttcaaatggataaaatcctccagaatacatatcctgaaatccgtattttttctgaaaatcagagaaatattttgtgaatcggtcgccggtataagtgaatcctgctgaagtagaaagtcctgctcccgacccgataataatcgtatctgcttcttctattttttcttttaattgttctattttattgaaggattccttcgtagattgctttgtccaaatctttgaaaacattgaatatcacctttcttacacttgtattttgtttgagaaattctttgacagttgcaactgcaatttgggctgctttttcatttgggaaatgaaattcccctgtcgaaatacagcaaaatgctacactttcaagtccattttctgccgcaagagcaagacaggatgtataacaggattttaaaagttcacagtctttttttgtaactgttccttgtataatcggaccgacagtatgtaaaatgtatttacatggcaaattataagcttttgtaatctttgccttacctgttgcttcagcatatccttgttcttcaataatttccgcacattcttctcgtagctgcattcctgcaaatgtatgaatacagttgtcaatgcaacgatgatttggaacgtaacagccagtcataccactatttgctgcatttacaatcgcatcacatgcaagctttgtaatatctccctgccagagaataatccccggctggatttcccctaaattgtctggctccacaatgcctttccgcttcttttcttcctgtaaatatgcatcctgcacttctaaaacttcttttcttacaggatgcggcatgcggatattcataagtccccgaagaagcagccgctgttcctctgtattcgttggaatctccattccacgatattgtgcattttcttttaaaagttcctgtattaaataaattcgtcgttctgattgattcatcatgcactttcctttctttttgctatatttttctgcttactataccttctatttgttatatcttgggattgcattattacgttaaaaaagtccgttatacctcaagatagcactattatatcgaaaaatttgcaagaaaaaaagtacgcacaaattgattacatagttacctggaagtaactgtgcttttttataatatttatccttttccagagaatgtcacgctaagattaacatagttagttttacgacaaatgataattttaatatagaggtattttcagatgaaggaaccacaattactacagacaaaagcttatgattatttaattgacctgattaaaaaagggaaattaaaaacggataaaatctattctttaaatcagcttgctaaggatgctggattttcaaaaattccatttcgtgatgctgtattgcgtcttgaacaggaacgttatatcgacatccttccaagcagaggatttactctccataaaatgaccaaagaagacattatcgaaacatatcagatgagaaataataatttcgaccatcgccaaagacagcccgtaagaaataatctaacccctatatgtgacctcggagcaagtgttgaatacgagcgctaaagcgagcattcaacacgccgcgactaaagtcacatataggggttagattggtgtgcatcccgtcaagtagacaattaaaaaaatataaaatttttgtgttgcccggttggatatcgggcaacatttttatgccgccaatcgttgcttttcatgaaattccattggtgttaagactccaagtcctctctgtggccggtcgtttgtatagtaatctatatattctgtgattgctttctctaattcttctctgctctcaaatttcttcccataatacatttcccgtttcaagatcccccaaaagccttccattactccgttatctgtacagtgggctaccctcgacatactctgtaccattcctgcttcttccaatttctgatgaaatcttcgggaggtatactgatatcctctgtcactgtgaaaaataggatgggctcctggatttgcctttactgctttatcaaaagtttcaaataccagcgcattattattactatccccaataacatatgcaacaggccgtctatcacataagtctaatatagcgcttaaatatactttatgtacactgtctaaggtatttccatacttgaattccgttacatcggtaacccatttctcattaaggtgttccgccttaaattctctattaagaatgttttctgcaataaatgctgggttgtttgaggctctggtacagccattataccggctctttaagttggaccagatctgtttttttctgcaaatacggaggatcctcttatcatttacctgaatatcttcatcgtggcgcagcttgtcatttaaccttctatatcccatatctggatgtttttcatgtaatcgttccagcttctctgccaattcctcgttaaatctctcattcggtgtctctgcatgatggagccatttgtagtaggatgacctggcgatccctcctatttcacataataacaggattggatagttatatttttcgtgttccttcttgattgcccgatagatatgttcctggcgtatcaggctcagcctcccctcctctctatctcttctaatttttttaagaaagatatctctatttctgcccgtcttttttccgcacgcagaagtcttacttctgcccgcagtttttctacttccgtcatttcctctggggattttctctttccccgcttatcctgcagcccatccaccccgttttcttcatattttatagtataacttctggcctgctgataagaaatgtgaaatttttttgctgtttccgaatagttatgagaatgttttatgcaatattgaacgatctcgacacgttcttcaaatgtagtttttctgcctttagtcatgattgctctacctcctgtttccttatcatgactattatacttcataatccatcttctgagtatctgtgcatctgaaattttgtgccgggcacagatatcccggagagaaccttttccagaaaggtaatcgaaaacagcggcttctttttgagcaggagttcgataggtatgcccttttcgaaaaaaagcttccggtccaattgctttataatttctaagccatttatcaacggtcgtataataaactcctatttttgacgcaacagaactgatagattctttcttctgaagaatttttttcatccattgtattttttcttctggagaaatcttatccataaaaaatgccccctttcagataaacagttttatttttttcaactgtctacctaaaagggagcataccagattatttcttacgggcgtctcctttgcctgcggcaactcagaatttaaagcacctgttttgctgcaccataaattcccgcatcgtttccgagagttgccagtgtaatttttgttttctgatttccatagaatgcatgatcatagaaatattttcttacagtctctaaaagaatatctcctgcttttgacacacccccgccaatgacgaatacagcagggtcaacggttgctgctaaatttactaatgcctgtccaagatatgcaccaaattcttccgtaatttctaaagccgctgcatctcctgcttttgctgcatcaaatacttcttttgcagtgatttcttttccagttaaaatactgtttttcgtatttttctcaaaatatctcttagccagacggacaagcccggttgcagaagcatattgttcaaggcatccttttcttccgcatccgcaagcctctgtctcatcatctcttactgtgatatgtccgatttctccacctgctccgtgagctccgactaccgcatgaccatcaatgatgataccgccgccaacgccagttccaagtgttaccatgatcaagtctttttctccttctccggcacccttccacatctcaccaagagctgctacgttggcatcatttccaataacacatgggaaacctgtgagttcttccaattcttttttgatttcttttgccatccagccgacatttgcggcacgttcaatggctccgtttttatctacaggtgccggcactcctactccaatgccacagatttcttcggctttaagaagtttttcagcaatttttcccttaattgcctctgcaacatctggcagaatacgttctccttcgttttctgtgtaagtcttaatctcccatttatcaagaagttctccttctactgtgaaaagaccaagttttacagttgttcctccaacatccactccaaaacaatatttcatcatgctcccctttctttttctacttattgcaattataaatttataattgcaaataaaattcgttttttatatagtatcacgaattcgccctgcttgcttccattataatattaattactgatacatttctatcattcttcaaacatgctctagtaaccaatattaatcatgaagcggctggatgatctaaccgatataatcgcctctgtcctcaaccagttcgtacccggcagaacgcactcgggcagacagacagtttttacatttagctgcctcatctcccgtacatatcttgttatcataaagctcatactgctttcgattttctactggagaaagatttggcattactacgttcgctcctgcactaagacctttttctcttcctaatggatctaacgttccaagtgctgttgttgccggaagtaatactttcggtaataacaatcgaagtaccgataataattttaatgttaaatctacgcttcctgcttcttcttttgcaaactttgtatcatgatgtggaataaacgggccaatgccaaccatctgtggttgtaattcctgcaaaaagactaaatcttctgccaaatgttcccatgtctgtcccggggaccccaccataaatccggcacccacctgatagccaagttcctttaaatcataaaggcattgtttgcgattagaaagatgcatactttctggatggagcatgtgataatgtgatgtattggccgtttcatggcggagcagatagcggtctgctcccgcttccttccatgctttatatatttcttttgatttttctccgactgataatgtaatcgcacaatctggatgtgctttctttatcttttttacaatatctgcaatccgctcttgcgtataccacgggtcttccccaccttgtaatacaaaagtacgaaagcctaacttttcaccatttgcacaacatgcaagaatctcttcttcactaaggcgatatcgttctacattacgattatctcttcgtattccacagtaatagcaattgtttttacagtaatttgtaaactcaatcagtcctcttgtaaatacttttgttccataatactgtttgcgtactttgacagcttcctcttttaaatattccatgacttcagaattattaaataatgaaaataattccagacattcttctttcgttaaggaatgcgtctctacaagtttttttgaaatgtccatttcttttcctctaaattactagttccactttatcattaataatactctggctcatctggcataataagcgctgcaacaatataaaataatacaccggaacctcctgctaatgtaaaaagaacaacgagcagacgaaggattgtcgcatcaattccgaaaaattctgcaaaacctccacaaacaccacatatttttctgtctaaagatgatttataaagttttttccccataacttattacctctttttatttcattttctgttttatttttttacttttttcttttttgtctctgttattacttctttttttgtttctgtgtggctgttgttgcctgtgaagcattttcttttggcttggtcccttctgttatctgctccgcatcttttttcggctgtttttctttggctgcctttcgctctgcttctgctttttttgctgctgcctctgcatcctgcgcttctttttgctcttttaagctatcactccactttttattaaatgtcgtataggacatagctggcagtgtgattgttccgtcttttcccggaatctggcgaacttctgcaatctgtgtctgtgcatgatctgcaagatagttcatctgataatcagcaagtttatccgcaatcaacaatgcctgccctcttgtaatacgctgattggctgttttgcaggaatcatctactgctaatgcacccgatgcaaaggaagcataagcttcttttgctgtttcatccattgtatctatactgctacaggaagccagcacttcttctgcctttttatccgatatagttactggatataattcctgaagaagctgtgcaaaacgagtagtcgttacagttccattttcattttcggaaacaaaagcagataaggttgcattatcttttaaagaatcaattgcttcgagcattgttccaagctgttttcttgtaattgccttgtttggtgcaaacagaccgtctttctgcgctggataacagtgaagtgcagaatattcgctataaactgcgccgtacttttgggaacttctcacatcgtaattacttggtgtcagggtaagtttaccctttttataattgttaaatgcgtaatcaaacaggcttcttatagaagcaaatgtactttctttactgacatttccaaagtaggcacaaatcagttcgtgtcctttataatccgctgctgttgcaataaatacatgacctgctgcattggtagtgccggattttgaaccgataattttatatgtatcacggtcataataagccattcctttcaaaaaccagtttgttgtattaacatacattccgcctttttgtgtggaataatgtgcctttgaaacagcacttcgaattaatggtattgccattgcgtaacggcatattttagccatttcctttgcactggcataagtttcattatatcctgcgccaatatcagaaccaaccggattatcaaaatgggtcttctttaaaccaagttctttacatttttcgttcattgcttctacgcaggcctttttagaaccaaaaacaccaactgccagagaatctgtcgcatctgctgcagaagacatcaaactcatatgtaataaatctttaaaagtatagtttactcctgcaccaattcctaagctgtatgtacccggcgttgtgcggtatacaacatcagactttgtctttatcacagagtttacatttcccttttctacacaaacaatcgctgtcataagctttgctgtacttgccggataaatctttttatttgcatcctgcccaaaaagaacttccccagagcctgcatccatcaccacataagcatggcattgtttcttcggtgctttcacttttgcctgtccctgcaaaggcagggcaataaacagcaacagtaaaagtattcctgttaatttctttttcatatcgcctctcctttttaattttctcttaagtttaatgattttccaaacacactctaagaaaagtttctggacaatcttctctccttacaaaaagacatatccatactatgtaacgccttataaagctttattatcatctccacacaaagttcctgactgtcgttatagagttcccagagatgtttacaggtttctgcatccgccggattgatttcttttggaataaaatgatgatgcagatctaattctggactgacatatccgccaatcactgttgtaatcgctctctttactccaaatccagaacggaaaatataattgatcaccagtttcatatgaaaaagactgacttgtatctgtttcgcagacttcttaaaatatggtgcaattacggcggcaatctcttttttatcctttatatggcaggctctcttataatgatttagatttctgccatcacgctgcatcacctcaaaatcccaatctgtctctatctctgtatgactgattcccgtttcctttatgcgctttcttacataaggatggcaggaactgtccagaataaaatgtgtcataaatccagcaagataggcaaatgcctcattcctatttttctgtgcctgaaacaccttaaatgcccgtttaaaaaactctctggcaggttcgtgatgtacttttaccccatactgatttactttatttttacaataagaatgataataaaacagaatatccggaccatgtacgccaatattatagtattcgatatatggttctatttttctttgtaattcttcgggaagtttatgaaaaacttcctgtccataggcataatgtgtatatgttgtcggcataacatcatctccttttcttgagtaaactgactattgtgacaccttaattccagtaatgtattaccggagattttcgcaaaatttttctttctgttattataatcactacagaatttaaaatcaaacgtatctgtaatactattttcttattttgcggcattcggtatagtaacgtttatcctgtgcatgtcccatagaaaatgtctttctcggtaatgctccatcatgaattactgtagggaacagttcttcctttcccatatccggtaaaataaatcctatgctgtctttttccctggcaaggctttctactacctcttctccatgaatgtaatcaatctttccgccattgtgtgccagatatccatcaagaaatctctgcaggcttcctactgttaacttagacgttggacgttcaataacacatttctttttctttccattataaatagtatagaaggtctgcccttttccttcttttttaatatgtaaagccgcattcatcttgcttaataaatcttctacatgaacaccggtaacaattcggtgaatcgcctcaaactgaagagcagggctgtgaagatttacaacctctacgagcgcatatctcgctgggtgctccgacagatcttcatctggatgtgcagcctttaactgttcatagtatgctttagcagctgcaagtgaatgattgccatctccaactgcaaacaaaagaaccggacggtcttttacatgatatttatcggcaaaacactttggatctgccaggaatgtaagtgctttttcaatccgtttcttttcctcttttccaagaagatagccacatagatgtccgccgcccatcataaggtcaaaatcatataaaagtggaagatgttccttttcctgctcacacggttctatgacatgctttcccgcatcatctacaagtagcataacgtgtggaagttccactaccgcattgttacgaatctccactctggctggaattctttctgctaccgttgcctctgttgctcttataaaagatgtactctttttgctataatcgtactgttccaaatcaatctttccaacaatacctgcgcgaacattcccaacactgtctgtccgctctacataaatcatcgcatctttatattctgtaaaaaccttttcatgcagatacttattcatagaagcctcaatatttttaagttgctcctcatgattttcctgttccaaatatacttccggcaaaatcatatcgagagtagagggactatcaccggcaaatttctttacctcttcccaatattccggctcactggtaaactggtcacaggcaataacagaccacttctccatatttacttcttttccaggcagtaaaatatctgcctctttaaatgttttcattattattctccctcttttgtgcttctattttttcagcaagatcatttaaatatacccaccgttccattttatcagaaagttcggcttccgtcttttctttttcttgcattaattcattcaattttatgaaatcggtcgcacatttgctgatttgttcttctaactctgtaattttttcttctaatttctcaatatcctcatcaattgtctcaaattctttctgttccttataagagaatttcaacttcttttctttatttttagaagcaagccactgttctcttccttctttcttcttctcattgctctttttaatatgaagcccggaaccagaatccacactgtcaatggaatccgtctcaattcttcctgatttttcctgatattctgtataatcaccctcgtagactacaatatttccattttcaaaagcagcaatacggtcaactgttctatcaaggaaataacggtcatgagaaacggtgatgacaattcccgcaaattcatcaagaaaatcttctaaaacccgaagtgtcgcaatatcaagatcatttgtcggctcatcaagtattaaaacgttcggagactgcatcagcacttttaaaaggtataatcttcttctttcaccaccagaaatcttagcaatcggcgtatactgcatatctgaactgaaaaggaaacgttctaacatttttgatgcactgaccagtccctcggaagttcgtacatattctgctgcatctttaatgtaatcaataactctttctctttcatccattacttcacattcctgtgcaaagtaaccaatttttattgtctctccccattcaatcgctccagaatcttcctgttctaaatctgctaaaatcttcatcaatgtggactttccacagccattatgcccgacaaatccaattcgttcaaatcgtttaaatatataggaaaaatgtttaaaaagtaccttgtctccatatgcttttgaaatatcataaagttcaatcgttttttttccaagtctggttccaacagatcccatctctacctgctttgctgtctttggggaatccatcgcttttaactgttcaaaacgctctaaacgtgccttttgctttgtcgaacgtgcccttgccccacgcattacccactttacttcactgcggagaatactttgtctttttctttctgaggcaagctctctttcctctctctctgctttccgttccagataaccagaataattttcatcataataataaactttgccaccttctacttcccaaatatgattcgttaccttatcaaggaaatagcgatcatgcgttaccattaacagtacaccacgaaaacttttaagataattctccagccagtcagacatcttattatccaaatggttcgtaggctcatctaaaatcaaaatatctggcttttgcaataaaactttacaaagcgcggcccttttcttctgtccaccggaaagatttttaattttctcatcaaaattctctaattctaatacagtaagcatcgccttcgcatcactctcataaccatagtcatcttctattttctttccttcacagacatactttaaaatactgctctcttcatcaaactcaggattttgccccatccagccaatcgtcataccatttgagaaaataatttttccctcatctgcttcttcctcgcccgcgataattcgaagaagtgttgacttaccggtcccattaatgccaataattccaattttatccccttcatctacactgcaggataagtcttccaaaatcatcttatccccatataattttgaaatatgctctacgtttattacactcatagtaaactcctattttttaacttttctgcgataacaaaaaaagctgaaaaccacaaaggtcttcagcttcttccaacaatgcagttgacgggacttgaacccgtacccagtcagcccggactagatccttagtctagcgcgtatgccaattccgccacaactgcttatcagtggttatctctctcaccgacgaaaattattatatcacaaggatttttaaaatgcaagaatttttttcaaatttttttgactttttataaacaaaacagatgaaacctgagaaaccaatatgcagtattggtttctcaggtttctgtctcttgcctacagaataattgaaaaatacgactgccactttctctggggggcgtctcccccttgcctgcggcaattcagaatttacttaaagtattctactccactttcgaaaatcttctgatcctgttttgcgtaaatattcttagcaatattctctccgatacgttcggaatgtgccatcttaccaaggacacgtccgtctgggcttgtgataccttcaatagcatagtaggaaccatttggattgtagcggtcatccattgtaggttctccgtttaagttaacatactgtgttgcaacctgtccattcttgaataatttttcaatccattctttgcttgcaacaaaacgtccttcaccatgagatgcaggaattgcataaatctggtcaagtacggctttacgaagccatggggacttgttggttactacttttgtatataccatagtagatacatggcggccaatctcgttcattgtcagtgttggagaatcttctgtctggttaacgatttctccatatggtacaagaccgagcttaacgagtgcctggaatccattacagataccaagtgcaagaccgtctctctcgttaagaagcttcataacggactctttaatcttttcatttctaaatacggttgcaaagaacttcgcagaaccttctggttcatcacccgcactgaatccgcctgggaacataataatctgtgcctggctgattgccttttcaaatgcatctacagattcaagaatgtcggattctgactggttcttaaatacaagtgtctctacttctgctcctgcgcggcggaatgcctttgcagaatcgtattcacagtttgttcctgggaatactggaataaatacctttggaactgcaactttatttttgcatacataaatgtcatttgtacggtataatggctgtgatacgttatgtttcgttgcatttgtctttgtagggaatacagattctaatggtttctgccatacgtcacacatctcttttaaagaaatctcttcttcaccaacctggaagaatggatcatctgtaactcgtcctacaaatatattcggcagaactgccatctcatccatccattctgtaggaatctctacaagaatagaaccataatatttctttgtaagatcttccttattaaagtctcttactaacttcacaccatacatatttccaaagctcatcttgctgattgcctcaatcagtccgcctgctccaagagcatatgcagatgcgataacatctttacgcattaatttatgaatcgtatcataaatctttccggcctctttataatccggaataccatattcatcaaatggaatatccacacgaagaagattattacctgctttcttaaattctggtgttacaacatgggaagcctttgtataatctacagcaaaggaaactaatgttggtggaacatcgatatcttcaaaggagccagacatactatcttttcctccgatggatggaattccaaaacctttctgtgcattgtaagcaccgagtaatgcagcaaatggtttaccccatctcttaggatctgtgccaagtctttcaaaatattcctggaatgtcagacgaatcttacggaagtctccaccggcagctacaatcttagctacagactcaagtactgcataaacggctccatggtatggactccagcttgaaagatatggatcaaatccgtaggacatcatcgttgtaagttctgtcttaccttctaatacaggtaacttcgctgtcattgtctggattggagtaagctgtgtctttccaccaaatggcatggtaactgttccagctccgatagagctgtcaaacatttctactaagcctttcttagaacatacattaaggtcagaaagtttctctgtccacatctcttttgcgtctttgaattcatcctgttttttgtagtaacattctttctcgtcaggcatttctacttcaaccgttgtttcctgatgtgcaccattcgtatctaagaatgcacgagagaggtttacgatttctttgcctctccaggacataacaagacgttttgcctctgttacttctgcaactactgttgcttctaagttctcttcttctgcgtaagtgaggaactgttctacatcttttttatcaagaacaactgccatacgttcctgagattcagaaatggcaagttctgttccgtcaagtccggcgtatttcttaggtactttgtcaaggtcgatgcgaagtccgtcagcaagctcgccgattgctacagatacaccgccggcaccaaagtcattacacttcttaataaggatacttacttcctcacgacggaataatctctgaatcttacgttctgtaggtgcgttacctttctgtacttctgctccacaagtatcaatagactttgttgtgtgagctttggaagaacctgttgctccaccacagccatcacgaccagtacgtccacctaataatacgatgatatcgcctggatcagaagtttctctgataacattctttcttggagctgcaccgataactgcaccaatctccatacgctttgcaacataacctggatgatatacttcatctactaatcctgtagcaagaccaatctggttaccataagagctatatccctttgcagcgccagtagtcagctttctctgtggaagcttacctttcatcgtctctgccataggaacagtaggatctgcacaaccagttactcgcattgcctgatatacataggaacgtcctgataacgggtcacggatcgcaccaccaagacaggtagctgcaccaccaaatggttcgatttctgttggatggttatgtgtctcgttcttaaagctgatcagccattcttctgtcttatcttcaaattctacaggaacaacgatactgcaggcattaatttcatcgctctcttccatattatcaagaagtccgtcctgttttaacttcttcattcccataagagcaagatccatcaggcagataaacttatcctttctgtctccatatacttctgcacggtcagcaagatattcattatatgtcttttcaaaaagaggtttataatatccatcaccaaatgtaacatccttaagttctgtagagaatgttgtatgacggcaatggtcagaccagtatgtatctaacacacgaatctctgtcatggaagggtttctgtcttcttctccatgatagtaattctggatataacggaaatcttcaaatgtcattgcaagacctaaagaatcgtaaagtgccttcagttcttcttctggcatatccttaaatccgtcaaagattgcaacatctgctggttcttcgtaatccataacgagggtttccggcttcttctcgtctgtctctctggaatctaccgggttgatacagtattctttgatcttctcaaattcctcatcactgatattaccagaaaaaacataagttgttgcagagcggataattggttcttccttctcattaagaagctgtaaacactgcatagctgaatcggctctctgatcaaactgtccaggaagatattctacgctaaatactctgtctccctcttttttagggaaatcttcctcgtacaaatcatctacaggtggttctgagaatacggtaactgccgctttttccatcgtttctgctgagacattctccacatcatagcgaatcagaactctgacattactgacatcatctatagaaagatatgcctttaattcttctgcaagttcttttgcctttaccgcataggacggtttcttttccacatataatctctttacctgactcatgatatcctccaagtatgtttaattaaattgtgggacaattcagaaattatcccctgcttttctgttaaaaatatgataacacttttttattctatttcctatggttttatatcagtttcttcaaaaccatgaattctgacaaaaatcgacgaaaaaaattcaaaaatttttagattttttacagatgaatcctcttgattatctgaaataccaaaagatttgaatagacaaccggccttgtttccgcgtaaaaaatgataccatctgttggtgcttttacttcggaaataatctccccgctatctgccttcataatctgcgccaaaacatctcctctgctgacttcctgaccacattctgctttctttataaaaatgcctgcagcctctgtcatgatgggctctaaatctccctcttttaagacgctcgcaatataaccgctgtgagaataataacggataatccccattcttgtaaggaaacgcagaatagaagaaacggcctgcgctgccagttcatcatcaatttttcctgtcatgcctgtatacaaagaaaaagcctccgtaccatttctttgccagttattatgtaatgttgttctgtcaaatggtctgctttttgcctcaataacataaggcagtccgaacaggtttgcaaggctggtacttccatgttccggatcaagcaatcggatatgcggcataaacgttcccccaagataaaaggatggcagatgaatgccatatcggtatccttttgtcgtttccataatcgcatatgccacacggcttcccgattccccagacggatttccaggaaacaatctgtttaaatcggtgtcatcagaaatccagaaacgctttccaaaatccatcgacatattacttacagaagggattactaaaatgccattctcccccacaatgtctccatgcttttctatttttttcaatacatcaatcagctttgaacaaatgtaaagctgctggtattcatttcctctcaaggccccaacaatgcaggcagaatgttcttttccttcatttttcccaaaataatatccttttacattaatttcctgttgaaaaggagactccatcgaatataagaccttttcttccatgtaaatatcctctctttcttcatgtacttccaaacctttttattcttcattctgtaagaagatttttatgttaccggtgtcccaatttataaggtatgcacagggcgtactctaacaaaattaggatacatctatcggagttcttacttttattcgtactttccagcaggtctttctgttttacaaatccttgccaaaagctctccctcacaaactgccggatattctcttaaactaaaaatcattccatcacacggtactgttatctcctcgatttccgcaccaagaatgggacgcacgattgagcctatcatctgtccttctctcacataacttccaatctgcgctttaggaataaaaatcccacttgtattacagtgtactacttccacgtcatttttctttaccgttacagtctttttcgtaggcgaaacttctccatcaaaaatgtctaactctttcatcatccgaaaaacaccatccagcacttttttacaatagtcataatctatcttcagtgcgattcccgactcaatcaccacgttcggaatgccttttcttcgtaagctgtaagcaagacttccctcccacacagaagaagaattactattcatccacaacacaggaatccctgacttttgcgcaagttctgtcactttttttccagcattttccggcactcgaatctgcggaatctcccggataaaaatatcactcgaatgaatatcaatgcaaaaatctgatcccattaaatctgcaacgacttctgccgccatatattctatcgtatgtccatgacggctacccggaaacattgcattcatatctaatgcacccggagcattccgctttcttatctccagtgccatcggggtcacacaaggatatatatcgacaatccctcttaaatgttctctctcttccttaattcttcgtatcagctcataacagatatactgtccctgtaattcatctccatgaaccccggcaacaatacttaatcttggcatatcctcccgtatataatctggctctaacctgtttttctttatttttattggaagtcctaccggcatctgcgccgtcattactgtctctatcatctatagtctcccttctgttaattaaaaatcattatgacgcttttgaaataactctcaaaactattttttatacttccttttgcttttacggccgcttcacttattgaccttttggcttttgtgagctatcattaacttcatatagaatatactataaatttatcttttgcaaatttttatattaggaggatgtaaattatggataaaatagcaagttttaccgtaaatcaccttgatttaattccaggggtttatgtttcaagaaaagactatgttggaaaagaagttctcaccacttttgacctgcgtatgactgcaccaaacagagaacctgttatgaacactgccgaacttcatacaatcgaacatctggccgcaacctatttaagaaataatgatgagtggaaagaaaaagttatttactttggaccaatgggctgccgtactggatgttatttaattcttgcaggcgattacgaatccaaagatgtcgtaggacttgtacgcgacactttttcatttatcgctgattacgagggagaaattccgggcgccgctgcaagagactgtggcaattatcttgaccagaaccttccaatggcaaaatatcttgcgaaaaaatatttaaacgaagcgttaaataacccttctgaaaaaaatctgatttatcctgcataaatctttgaacttttcacatactacctcctgtacctaatcaatatgctcttatgtattctcggaatctttttatgcttgattttgtgagaagattttttgtcagttgtgcccaattttttgaagcgtacgcagtgcgtacgttgatgaaattcgggtgcggctggcggaaaatcagccacgaaagcaagcgcaagaaagactccgagagtacattcttaaaaaaggaggatttatcatgaaaagttcaaagaaaacctatcaggaagttgcagaagcctgtagcaaataccagccagtatctgaagaatacggatttaaaaattcttcctgtgaatgcaacacaccaagctgcttaaactgtactcattttacagatcaggaacactgtgatttagacttatatgatcagattgtagagagaatcaagtaacttctgatttgtagaacgaaacagacgccagcaaagagagcctatcccctatatttgtgactttagtcgctgcggtttgaatactagcttcatatgctcgtatccaaaccttgctccgaggccacaaatataggggataggctctctttgctggctgactgtgaatgctggcacaaaatcagaattcatgttagaaactttggggattctccagaatattatgaattcgcaaaaaaattagcttctctataacatagtataaaaagatattactttagagcgtgtttaaaaaatcattccagcaacctgcacgcttcaattttttcactgatttgttgaaaaagttcttgcattttaaaatatgttgtgatataatgattttcgttggtgagaaagccaattaataatgtgcagttgtggcggaattggcatacgcgctagactaaggatctagtccgggctgactgggtacgggttcaagtcccgtcaactgcataagatgagagctgaagattttatcttcggctctttttattttaatccattaatcaatataaaaatagttatgtatagtttatctggagtgatatctgctacataactattttttgaatttaatcaagtagcttgtttggataactataaatgcaaaagccataggagtagttgagtaacttctggagaagatttgagaatggccttggaagatggttactttttcgagtgataaaaccataaacaatttctaattggcgggaaaaataacaaccataaatcagtgtattattatgatattgatttaagcattaatcctacagaatttcgtttcctggatattccatatcttctgctttcttcctcaaatttttcaaaaaggaattctgactttgcacctgttgccaacaaacagaactcctgaagataaataaaacatatttgtgacctcggagctaggtttggatgcgagcacatcagagaacattcaaaccgccgcgactaaagtcttaaatatgttttatttattttcgggagttcgtctactttgccagacaggcaaatcagaagctaagcgattgtataccaattttcttttctgactccgcacaatggagataacttctcctgtaataccttaaatggttcctctgtgaaatacttagcctgtgttggacaaattcttaaacaggaaccacaacgcagacagatactgctgtcaatctcttttgggttactctcgctgattgcttttaccggacatacatccgcgcatagcatacagtagatacaatattcatttgtttctactttgaatggaaattctcccattggtggtttggtgtatggaaaagttccaggaacttctaagtcgccggcatcatatgtaacgagaagacgaaggcgttcttttaatttgtccccaaattctcctgccatttttaaatcttcttcatcaggtctgccctctgcacattcttttaagaatgtatgctggcagacgaaagaagcagcaccaacagggataaatcccttatcaattacatttttctttaactcaattaatgtatcatcaatatcacggtttccgtaagtcgctacaagaacaacaggcgtgtttgacccagtaaaatgccttaaggcatctacaactggtgccgggactcttccgccataagcaggaaccccgataataagaagttcattttctttaaaatagtaatcttcctgacgtgtagcataatctgttaaattaatagattctactggatagttttgaaaagatgatgcaatatgggaaacaactttttctgtagtgtttcctggactaaaatacgcataataaattttaagtaactgcataataaaaaaccccctgtgtattgaaaatttttaccattaaatctattataaaatgaatagaagaaagagacaaggtagcattatgcgggaaaaagaaaagtttttgttaatattagatttagatttgccataaaacaaaaaaagaactgaagattaaatcttcagctctcactcaatgcagttgacgggacttgaacccgtacccagtcagcccggactagatccttagtctagcgcgtatgccaattccgccacaactgcttatcagtaattatctctctcactgacaaaatttattatatcacagtgtttttttaattgcaagtacttttttaaattttttaaattttttcgttttttttaattttaagaaaaataatgctttttatagaaaaaacaagcgtccctatatcatggtatagtgtatatattttctcatatcacctcatttacactttttgtcttagagcgtgtttgaaaaacacgcttcagcttaacaataaagagtaacaaaaagagagaggttccaaagtataaagcatcttactggaacatccccctttttgggttttgcctgtttttaatttgagaaataactactctgtcgtgtaatcatttaaatactgaatatctgtcgtaaggtaaagcccttcttctgtaatataggcggaatctccatttttcaatgttacttttcctttaattggtactttatcgcctacatatacagatttaactacattatctgcagaaaaatcagcccacgcgcggagtcgtactcctgttgaactaatatatgtgattgctacataaccacctagcttttcataggatgtaagttcttctgtataattttcacttgcctttagatacatgccatttctcaaatgatagtacgtcttaccttcatagcttccctttttacttgcccagagaatctgtccgttcttcaaagataccgcaccttttttcttcttctctcccggcagctttgaggtataaattcctttttcaggcacatcttttatcataatgtatcctgactgaaatgttttgtctgtgtccagatactctttatgaatatcctgtgtactactctcggcttctttttgaacagcgtttccctgatattctcgtcctttcaaaaaatgcttaaatccaaaaataaatagaagtacacaaattaccagcgcaagagaaaaacccatagatagaaaagactttttagtggattccatatcctgattattttcttgttttttcataaataattaattgtcccaacttgtaagattatattttttaataagtgttgtcaattcagaaacataaccagaccaggtacagtagccacctttttgaagaattgaaagctgtgtagaataactctttgttgtggtaagtccattatagcgtctgtgtgtaccattcattgcattagaaagatatgctgaatgatcagcaatcgactgggctacagaactatatttacggaacttagctgtaataattacctttttcccgttatattcttctgttgtttttacttccgcatagctttttccatcccatgcagaaccagaccagctgttaccggaaagagatgttttcattccaaacatattgttagaactttgtgtaagaccagatttgccccagccgctctcgttgattgcctgtgctaatgttacagaagcaagtactcctgtctttctgtaatcttctcttgcaatcggacctactgcgttaacaaattcctgtgtactcatattcttaaaagcggttgcctgcaggctgctacctactgtcgttccattggatgttgatggtgcattcgttgttatcgcttttcccgtcatgtagattgcttttctcgctgcattatatgtataattgatgcctaatgcctcacacactaccttagctggaaccataatcaatcccgttccacccacttttgccttaaatggagctgtacgaatcttttctttctttccatttatgtaagcgtatgttttattcaaatataaaactattttattaccattataagaaagtgttaaaaccttgcctttgttctgctttgaataagatacttttggacctctttttaccattgtataactataaggtatcataatatttccattaaccattaatcctggtcttgtcacactgttcactcttttactattataatacactttgtaacttgaaccagtataacgaactcttttaccgcctctgctgtaagtaactgctgccgcagcactaagcgaactaaatgccagtacaaacaccatcaaaaaaattgcagcttttttaataacctttacatttttcataactatctcctcccttttagaaacaaaaattaatgttatttaataaatggacaacttttttgtaaacaaaaaaggccaacagataatatctgctggccttaatcttcattaagctaatttgctctttgctaattctgcaagagctgcgaaacctgccggatcagcgattgccatctcggaaagcatctttctgttaacttctacgcctgctaactttaagccgtacatgaacttgctgtaagaaagtccgttcattcttgctgcagcgttgatacgtgcgatccataactgtctgaactgtctcttcttctgctttcttcctgcgtaagcgcttgttaaagctctcattacggactgtttagctactctatactgtttagatcttgctcctctgtaacctttcgcaagcttcagtgttctgttatgtcttttctttgcgccaattgcgccttttactctagccattaattacttcctcctatatacgattaaagatatggtaaaatcttcttcatgttctttacgttagttgcatctgtcattgcagcttttcttaaatttctttttctcttctgagatttctttgttaagatatggctcttgtaagctttatttctttttaactttccgctacctgtctttttaaaacgttttgcagcagctctgcttgttttcatttttggcataatattagtcctcctaatttctaatcttaattaacgtttttcagttaaaaacattatcatacttcttccttcaaatttaggctgcttatcaacaacagctacatctgaaagctgctcggcaaattcttcaaggattaccttactggaattcacatgagcaagttctcttccgcggaaacggagagttactttaaccttatcgcctttggaaaggaactttctagcctgattaatctttgtgttcaggtcgttcttatcaatgtttggtgaaagtcttacttccttcacatcaattgtcttctgttttttctttgcttccttttctttacgggcaagctcatatctatattttccataatcaataatcttgcacacaggcggctttgcattcggagcaatctttacaaggtcaagctctgcttctcttgcaagcttcatagcttcctttgaagacataattccaagctgttctccattactgctgataactctgacctctctgtcacgtacctgttcattaatcattaattcgttaatagtagtacacctccataaaataaaaattagtccggcgattcaagtacacctttgtgcccaaaccccatgaaaaacatagaaaaaaatggacagtcacaagaccatccacgaatatctcataatccctgccataagcagttcattatacttacgatatcaacccgagtcaccattgtgctaaggtgagagtggacactctgcttctttgttactcaataaccttaattactatagcattacttaagtaacatgtcaagtctttttaaaaactttttttaattttctttaaaaactctttttacattaaaatatatcttaattatatatcgtctgtgaaatacctcgtaatctaattatcaggaattcctgcttaaatttctcaaaatgtccattcgtcaatggctatttcaaaagaagtgaaatactctgtcccggaattaattataaatctaaaactaattccttgccttctttctggtactgtctgtaagtaattcctaccatatcaagcattcttttagccgctattgtagaatccgtgtccgcatacttatcagaataataaatcacctctgtaattcctgcctgaataatcgctttcgtacactcattacaaggaaataatgtcgtataaatacgtgcacctcttaaagaaccaccactgtaattaagaatggcattcagctccgcatgacacacatacaaatactttgtatcaagaggagttccttttctctcccacggcattctatcatcattacatcccgttggcattccattatatcccatagaaagaatcttattatgcggatttacaatacaggaaccaacctgtgtgttgttgtccttgcttctttgtgcagaaagaagggcaacccccataaagtaggcatcccaggatacataatcttgtcttttcattgctcactctcctatcggcattatttctttaatgataacacaatcaaaaggtaaaaacaattctgatttgcgcagcaaaggagacgctctcagtaaataaaataacctatatttgtgactttagtcgctgcgggttgaacactcgcttacacacgctcgtatccaacccttgctccgaggccacaaatataggttattttatttactgagagctgtctttggctgcctattcaaactcagaatttattttgagaaagatttgagagagaatttagcttcaggagttcgtctgctttgcagcctcacaaatcagaaattagtcacctaaagcaaatttatcatgtactgcattcagtgccttttctgtgtatttctcatcgataaggactgttacgcggatttcagaagtactgatcatcttgatgttaactcctgcatcgtataaagcttcaaacatagaagctgcaacacctggatgtgtcatcattccagcacctacgatagaaatcttagccacatctttttcttcatcaatcttgttgtactcgctcttagggaagctcttctggatgattgctactgcttcatcagcttcgtcttctgctacagtaaaggaaatatcctttgttccgttacgtcctacggactgtaagataatatcaacgttaatgttatattttgcaagtgcattaaagaggtggaatgcgattcctggctcatcctttaatccaattactgcaattcttgtggcattcttatctgctgcaacaccgcttacaagcatcttttccatgtttacttcctccctgacgattgttccttcgtgattatttaaactagatcttactactaactgtactccatacttctttgccatttctacagaacggttatgaagaactcccgctccaagagaagctaaatcaagcatctcatcatatgtgatttcagcaagctttcttgctttctttacataacgtggatctgctgtatagacaccatctacatctgtgtagatttcgcaggcatctgcgtgaagagctgctgctaatgctacggctgttgtatcagatccgcctcttccgagtgttgttacattatcaaacttatcaattccctggaatcctgtaacgagaacgatttttctctgctctaattcgttgcggatgcggtctgtgtcgattctctttaactgtgcgttaccatagcgatgtgtggtgtgcattgctacctgaaatgcattcagtgaaatagctggaactcctaaagagcccattgccattgccataagagatacggaaacctgctctcctgttgtcatgagcatatccatctctctttttgatggagttggattgatatcttttgccatatcaatcagctcatcggtagatttacccattgcggataaaacaacaactacatcattacctttctggtaatcttcgatacatcttttggcaacatttaaaattctttctttgttccctacagatgttcctccgaattttttaacgattaacattctgttcctccctaagtctttcagtttttatctattgtttcaatttacgattgacttttcaagtgacataaaaagtaaccgtaaaaatcatatctttattaatatactgcaaaaatcttcatgcccgacttatcagacaaatcatagataaaccaatatatcaaatttctatgagtactttttattatgccaactattctacatagtttttaacaatcagtcaagacgaatacgattaataatatgtccggccttttctgctgcttcattgaaagcactctctttcatcactcctgtgataaatgccttttcattgataccttctacagataccatctctactgctccaaatgctgctgtgattgcctttgcttctgcatctgccggcattcttacaaaatactgtctctcgaagtcaccgaggtcacttaatgtaagtttctccggattccaaagaattttaatatttttaccagtatgttttacacaatctacgacatctgctgctactgcactggctgtcggaagctttcctgctcccttaccataaaacattgtctcatctaccatattcccacggacaaaaatggcattaaatacatcatttactccggaaagtggatgtgcattatctaaaagcatcgggcagaccatcgcataaatcttaccatcaactctccaactgtttccaagaagcttaatacttttgttcatcgctgtagcatagcggatatcttctgcagtaatgcttgtgattccttctgtatagatatcttcaaaatctacctgctgtccaaaggcaagagaagataagatcgcaatcttacggcaggcatcataaccttccacatctgcttccggatgaagttctgcgtaacctttttcctgtgcttcttttaatgcttcctcaaaagagattccctcttctttcattcttgtaagcatgtagtttgttgtaccatttaagattccgctaacttcttcgataacatctgcggtaaggcactgtactaacggacggataattgggataccgccgccgacacttgcttcaaacaaaaagttgatatttttctcatgggcaatggcaataagttctgctccatgctttgcaacaagttctttatttgaggttgccacgcttcttccgttaagtaatgctctttttacaaatgtgtatgcaggctctacgccacccatacattctacaacaacctgaacatcctcatctttatcaataatgtcatagtcatgaacgactttatctgcattcggatctccagggaaatctcttaaatccaaaatatactttacggctatttcctctccggctctctgtgcaatgacttcggtattggtctgcaatacttctacaactccagaaccaattgtaccatatcctaacaccgctacatttaccatctttatcctccttattcctctgaaacaatcttcagattattaatcccatctgcattttcaattctatcaaaaagtactgccacatcttctgtgattggtaaaatcattacactaagtgttatcagtgcgatatgattcaccggtatactctgatgtatcgacaagatatttgccttgcagtctgccacaattttcagtatactggaaagtaatcccggctgatcttccatttccattacaaaggtaattgtctttccctgaatcttttcatgaatcgggaaaatgtcatctttatatttgtaataagaactccgactgattccaacggcatcaatcgcctctttgattgtttttgcctttcctctgtttagaagaacatttgcttccgctacttttaataaaatttccggcaaagctttcttctttaccatataaaatttcgaaccattctccatattgtaatctcctgtacagaacagtaatttctctcttctgcatatttgttcgccagtgaaacacatttgttctcacctgaaagatattatcatattattcccatccttgcaactgctttttttaaaaaaatgcaaatctaaaactcttttctttcatttttttattaaaatccattaaataaacacttttataaagcgaggtatgcagattgttgaaataatttttcaaatacgctctgtccgttctttcttggaactttctgtcaaacttcccataacaaaaagaacagataccccgactatttcatcgatgatatctgttcttttttaacattctaagtttcgtttacacccaacttctatgtatggaaataaacactataaattaatctacaactacaccgcgaaacacataagcaatcaattcacaaaactcccagtattcaggaaaattctccatatctttcagcgagtcacataatccccgataataccatgcctgctgccttttatccttcatattaaagcgttcccacagcttatctccaatcatctgataatctctttttaaagatctggcattcgaaagcttatctcctaaagcaaccagcttcatatcagaagccttttcttcctttaacctttttactgtattagccttccgctcgttccaggaccccccccttttcctcgctctcagcctttacaatctccgccactctttctccaaactcctggcagagtgtagaaaacgttacttccttacaatcttccaaagtatcatggaggattgccgctgcaatcacttccttatcctgcgtcatccttgagacaataacccccacctctaatggatgaacaatatagggaagcttggttccttttcgaaactgaccctcatgggccttcgtagcaaatgtaatcgctttatcaatcatagtttatttaacattctccttttcagccgctgcttcttttaatactttttcctgagcatctgctggcatctgctcatatctgctaaattcataggagaactctccacttcctccggtcatagaacgtaagtctgtagaatatccaatcaggcttgctaaaggaatatctgctactaattcctgacggccaccctctaatggattcattccaagaatacggccacggcgtttgtttaaatcgcccataacatcaccggtattcttatcaagaacgtctaccttaagatttacgattggctcaagaagaactggtttggcatccatcacaccattcttaaatgcagtaattgctgccatcttaaatgccatttcggaagagtcaactggatgataagaaccatctgttaatgttgctttaattccaactactggatatccagccaaaggtcctttaaggcagctttctgcaatacctttttcaactgctgggaagtagttctttggaacagctccgccgaaaatcttctcatcaaatacatatggtgtctctaaatcgccagacggttcaaattccataagaacatcaccatactgtccatgtccaccagactgttttttatatttgcctcgaacttctactttactgcggatagtctctttaaaggctacctttggttttacaagttcaatctctactttatatctgtcggcaagcttactctttacgatttcaagatgctggtctcctaaaccatataataacatctgacggttcgctttgtcattaacttcttttaatgtaaggtcttcatccattaacttcttaagagctgccgaaatcttatcctcatcacccttggtctttgcaatgtaacgaacgaatgtatatggttctggcatctctgccttctcaaatatgattgggtttgcctttggtgataatgtatcgcctgtctttgtaacagaaagttttgcgatagcaccgatatcacctgcataaagggcattcacttcaatctgttccttacctcttaatacataaagcttaccgatacgttcttctgcgtctttatttgcattataaacagcactgtctgcctttaaaataccatctgtaacttttactaaagagaaacgtcctacaaatggatctgcgattgtcttaaatacataagcacttaccggctggcttacatcgtaagatgcactaactggctcgtctgtcttcacctttattccaacgaactggtctgttaccatacctggtgcggagaaatattttaccatatcgtgaagaaggatattagcaccgtagtctgtgttgatcgcaccacagataactggcataagatctctcttagcaatagaagaaacaatcgctgtcttaatctcttcttctgtaaatggttcttctgcaaagaacttctccatgagttcctcacttgtctctgcaacaccttccattaactgctgacgatactcgtcaagctcatcgttcactccttcttctacttctttttcgtagtaagttccatttggctgtaaacgacattcaagcatcttggctgcattgataaatcccttaaactctgtgccttctttcattggcatatggaatggtacaatcttgttaccataactttcacgaagttcatcaatgattgcggaagcatctacatgttcatcttctacacatgtgatgtatacgataacaggaatacctctcttcgcacagaaatcgaaactctttcttgttccaacttctacacctgacttaccattgataacgatgattgctccatctgctacgctcaatgcttcatatacttctccagagaaatcaaagaaaccaggagtatctaaaagattcaccttaactccgtctacctctaatggaataactgaggactgaattgaaaactttctcttaacctcttctttgtcgtaatcacttactgtaccgccttctgttactgtacgaaccctcttaataatccccgttgtaaaagccatagattcaattaaagaagtcttaccacagccaccatgtccaagtaatacgacatttctaatactttcggttgcatatacgttcataatcagttcctcccgtgttgtttaatcatatttgtgagaattttacgtcagaatttgtaggataaatgaatcaatattcttatgtcaggattctcacaggtctattttaacaaaaaacttgtcatttcacaagagtaattttggcattttgacatatttttttgaggacacagaattatgccgagtcattatggcttcctctccataaaaactgcccctaccatctatttacaacatcgtttctcttgcgggttgaatgttcgcatgtgaatcatatagaaatacatataccttctacccttttcactttagcactaaaaagtgttgacatggtgtgaatttccatgtacaataaaagccattgaaatctcgcatcagtacactaacctgcgatattgaacttcctggtggaaatctatcccacggcatattagagcgaggattgaatgtgagtatggaagcgaacattcaacccgcaagcgaaacgatgccgtgggatagatttccaccaggaagttcactccacagccttcatccctgatgcgaatacaaaattcacactttttggaggttgcaccatgaatgcaaatcatatgacaatcggctttatcggccttggacttatcggcggttctatcgccaaaacaatacgaagaattcatccggatagtattatctatggatttgatacagatattgattctcttaaaatggcaaaggaagatggtacattaacgcagtactttgaaacacttgaccctacattttcatcctgtgatattatctttctctgtgcgccggtatctaataatatcgagtacttaaaagaattaaaaggaatcatttctgaaagctgcctgcttacggatgttggtagtgtaaaagaaccgattcagtctgccatcaaggaacttggcatggagtcaaactttatcggcggtcatccgatggttggttctgaaaagtcaggctacgctcacgcaaatgatcatcttcttgagaatgcctactatttcctgacaccaagcgagcgcactttattccagcttacgacaaagttctcctcttttattcagggactcggtgcacttgccgtttctttaaaaccagaagagcacgactttatcactgcagctatcagtcatgtaccacatattgtcgcagcagaacttgttcatcttgtccgccgcgcagaccgcaataatggtatgttaaaacagcttgctgccggaggttttaaagatattacacgaatcgcatcttcttctccggttatgtgggagcagatttgtgaaaataactcttcaaatataaaaacgcttctcacatccatgattcatgatttacaggaagtcattgaccagcttgataaggaaaatggagcatatgtgaatgaatactttaaagaagccggtgattaccgtaattctgtaccagaccattctatcggactatttgacaaagtacataaactttatgtccatatcccagatcagccaggtacaatcgctactgtcgcttctcttcttgcctttaacaatatcagcttaaagaatatcggcatcatttataatcgggaatttgaagaaggtgttcttgaaatcgttctttatgacgaagaatcctgccagaaaggcgcacaggtattagaggaaagaaactatattgtacatattcgttaatttatccttttccagcaagaagactccgacctctaaggtgggagatggattgcgtctgttacctacttgatattgcattctaatcatagtataatatattcagtcgcatgataaagaaaggttgaaatacaatgaatttagataataatgcacattcagtattcttactgcactatcatcttgtgcttgtggttaagtatcgtagacaggtttttgatgatggtatttccagcagggcgaaagagatatttgagtatattgctccaaactacaatattactcttgaggaatggaatcacgataaagaccatatacatatccttttcagggcacaccccaatacggaaataagtaagttcataaatgcatataagagtgcaagcagcagacttcttaagaaagagtttccgcagatacggcaaaagttgtggaaagaacatttctggagccagagtttttgtttgattacaacaggcgatgctccaattgaagtgttcaaaaaatatatagaaagtcagggacaaagggaccgaaaaaggaagtgacagagtggcgaacagagcatataaattttgtggttacaaaaatgcaaaaacaaaaaatcttgcgttaagagagtaggattgtccgcagtgcgggacccatcatgacagagatgtaaatgcggcggtaaatatcagaaatgagggaatgcggctggtaaatgcatgaccttagaacaaatacaaccgtgggacacacggggatagctcgcttatgcttagcacagtagtgttatcgaacgagaaccaaacttgctgaggtgggggaggatgtcacattataatcagttatgactataactatcatgtattagagcgtgtttaaacacgcttcagtataatagcaaactaatgtactgaccagttatataaaacaaacgaaaacgaggatctatttatgaaaaagataacacgaaccaccggcctgaaaggaacactcaccgttcccggagataaatcaatcagccacagggccattatgttcggctctctctctgagggaacaactacgattcatggcttcttaaaaggggctgactgcctttctaccattgattgcttccgcaagatgggtatttctattgaagaaaaggacgaaaccatttatgtacatggaaaagggcttcacggactcagcaagccagaagagactttagatgtcggcaacagcggtacaacaacccgccttatttccggtattcttgccggtcaggattttgatactgttttaagtggagatgcttctttaaattcccgccctatgggaagaatcatgaaacctctctccatgatgggagctgatgtcacaagcattaacaataatggctgtgcacctctttctattaaaggacatactttaaatgccattcattatgattctcctgtcgcttctgcccaggtaaaatcctgcgttcttcttgccggattatatgcagaaggaacgacaagcgtcacagaacctgctctttcaagagatcacacagaaagaatgctccgttcctttggtgcagatatcgtatcggatggaaacacctgtaccatcactccgccagagacattacatggacagcatatcgaagttccaggagacatttcttctgctgcatttttcatcgtagctggtttaattactccagattccgaaattacaattaaaaatgttggcattaatgatactcgtgctggaattttaaaggtatgtcaggacatgggtgcagacatcactttattaaatacccgcgaagaaggcggggagcctgttgctgatcttcttgtaaaaacaagtaaacttcacggaactgttgtggaaggaagcattatccctactcttattgatgaactacctgtcattgcccttatggcctgctttgcaaaaggaaaaaccatcatcaaagatgctcacgaacttcgtgtaaaagaatccgaccgtatcgcgatcatgacagagaacttaactgcgatggatgccgatgttattgataccgatgacggatttattattaacagccgctcagaagagtctattcctgttcttcatggagccgaaatcaactgttctatggatcaccgtatcgccatgacatttgccattgcaggactgaacgccgatggcgaaaccatgattactgattctgattgcgtggatgtttcctatccgggattttttgcacaattagaggctttaaacaactaatagaaagatatttttccaaatatgtgtcaccatttatgagaaaggaatactatgagaaaattaagaaaaatcttacttagcaccatctttgcactcactgtcagcactactttttttgcaaatacagctggtacacaaacagtaactgctgcatctggtactgctgtcacatttaaaagaaaagtaatcgcctaccgaacaggctctgtttacaacttcgttcctatgggaaatgcagctgataaccgccgggcattaaatcttttaatggaaggaaatgaaaaaaaggtaatcaatatcaataataatgttcatattgatacttatttgcgtccgggaaataatacaacaatcaacgctggcaaacataccatcacctctgataaaggagttattatcaacgatccaactgctgcttcctacacaaactttaaaaaccttacaatcaacggcggcatctggaagaattcttcctccagtggattagctggtactatgatgcgtatcagttatgcctcaaacatttctattaataatgctacggtatatactaattataagggacatggaatcgaactcatttcctgcagcaatgtcgtagttaataactgtaccctcaaagcacagggcaaatgctccaaaacctgcgtggaagaacagttacagattgacctgtcaagcccgactaccgcacctggcctttaccgtcttagtaaaaagctttgcaacggtacaccatgtaaaaatatcaccgtaaaaaactgtacgattcagggtgcccatggtatttgtgctaactttgcaggcgcaggcaatgaagctaagtaccgtaaagccagaaattatcattccaatatcaccattgaaaattgtaacgttactggaatctcggcagaagctattgctcttttcaatacaaaaagtgccacagtaaaaaactgccgcatcacaaccaaaacaccaaaaagccgcaactcctattctgtcggcctggctgttgcctaccaaaaaggctccgctccaaaagcaactactaaaaatgttatcagccttataaataatactgtaaaaggcggacagcagggtatttttgtacgctctaacgcttctaaaaaattaggaactgttattgtcagtggaaatactgtctctgcgaaaaaaggaaagaaaaatgccattaaggtattgtccgctaaaaaggtgaaaatagcaaaaaataaaacgaaaaaatggtaagagaattctgatttgctgcaggcaaaggagacgcccgcagaaagagaaataacctatatttgtgactttcgtcgctgcaggttgaatgttcgcttaaccgctcgcatccaacctttgctcccaggccacaaatataggttatttctctttctgcgggctgtttgttggctgtagaagtaaaatcagaattaatcttagcggatttggggattcaccaataggtcgtggctttccgggcaataaaatattaaagattgacgcgtaagatattgttataatatcataaccattttacgataagaacctgaattacaagtggataaaaatctgcctttttccggttgattcaaggggattagcatattattttaggtgtcaatctctttgaaaagtaatttgccagaattcctatttctcctatccccttctccaaatctttttcaactgatttgtaggatttggaatagtcagccgctgtaaattttctgtcggattgctcaaataatacgaggaagaacccctaaaaaatttattgaattttgtgactttgtgctgtggaattttgaccatagaaacttcggactgctttctccgaagtttctgtactattgggcaaaatggagcgtttagcacaacggaacaaatcaataaattttttaggggttcttttcaattattcttcgggcaatctggctttcacttttcttatagcagcgggttcgtctgtttcatagactcacaaatcagaagctatttcattttaatttttacggtcttcttctttccgcttccatctgttgccatcgctgtaatttttaccgtttttcctttggctgatttcttcgttgttacaattcccttagcatttaccgtggcatatttggtattgcctgatgtccagagaagttttttatttgctttctttgtggcagttactttggcttttagttttagtttcttgcctgcttttactggcttacttcctgttatcttaattttctttacaatgcctttcatagatgtaatcttccatgaagcatattttttactgccatctgttgctgttgccgtaatcgttactttcttaccgccagttttctttttcagtgtaacaactccaccttgcgttacggttgcaacctttgtattgctggacttccagagtagctttttattcgaagcagtctttggtaaaacagccgcttttaaagtaagctttttgcctgcggcaatctgtttggagagaccggaaagacggattgaggttacctttactttctttgacggttttttaccagtatccggttttggtgtatttggcttcgcattttctaccgtaattggcataacaacttttcgtccgattccaatttcttcataaagaatttccagttgctttttgcctgttttagacatatcgatatttttcacatttgttgtataacctgttacttttgccttgcttccatcagtgtatactgcggtcacttccaaatcatccagatttagcttctcgcctttagtataagtaacctttgtttttgttgcggtgagataatccaatgtttttaattcttctgttcctacataaacaaatgctgtattatcggactttatgctctcttctgcatctccgctaacttccatgtaaaccgtatcacttccgagttttttcaattcttcttttgtaaatgttttctctaccgtatcataggattccacatttccaagatttattgtttttaatactttaccagaagcatccccagcttttaaagtaagtgctgctgtcgtatcaaaggcactgttattatctatcacagctgtaatattatcatcctcttgtttaacagaaagagcaagttcacttccggccgactgaatattttttgtagaatctgctgttgtattttcaccagagattgcttctacttttaatatttcttttgctaccgcatctcctggtacagtgagatctactgtaacgtcttgtgtctctcctgctgttattccagcttccaagtctgcctgtccaatgacgttgccattatagacaatctgaacctttccctcaccacagtttgttaatccattatttttcactggtatggtgatagaagcatcctcgtccggcatcaatttctcctgcgtgtaatcaatatccccgatgacaagtttgctttgtggcactacagaagtgatacataaatccgtattttctgttacagtattctctgtaatatctacatcggttcttgtaaataaatattcatacgccgtcccattccagataccactcggcactgctgcataaccttctaaatctgttaaagtaactggttcgtaaacttctccatctcttattacataggcatatagatttcttccagcttcttctgcattttctttctccgatgaacagatgagaagctggctatctccaccatctactaccgtataatctgcggaaataaccgcatcgtcttctatatagctttctaccgctccatctatagcatcaatatagtttaaggaactgccttccgcatcctgtgcataccataaaagaacggaacttccatctatttttgcaaaagaaggagaaagattctgtccatttgctgcaatggttgttcgtccttttgcattaaccgtcgtcagttgtacctgcggattttcctcggtaccagaattcaatgtataagctgttactacatcattatccaaattgccaatagcaacagactgtaccggcttattctcttctgataacttctttgttgtaaatgcatttccatttaaagatgcaaggtaaactgtatttgttccggttccctttaaaatatcgttcgcactattgctgttccatgcaatatatggcacatgattttttactgtaatagacggatgcaaatccgcaatggcattatccgtaatagccggatactttgtcactgttcctgtatttccatttaatgtgatttttgctgcctgaacttcggtctcggctgcaagctttgtcataaaatcttcagcctctgcttcttccggtgtaaaagtccgctttgcattaatccatgtaacgtatacattctctccatctactgctgctactgcatcaaaatctgccgttccatcatcatcaatcagcttaggtatactccacccacgttcattataaatagaatataccactgctgtatgattccctgttgttctgtcgcccatgtccgttgtaaaaataaggagtttctttccacttgccgtctgcaaaagctgcggctttgcactggcatacacatcagacagcaatgttgtcactgttccagatgtattttttgcagaagcagcacgctttatcgaacgtggcttcgctgtttgttctgcaacggcagaaccatcccacgaagaagaatctactctttgtatttcataatctttcgcctccggttctaactttggcaatgctctggtatacattctggcttttgacttcttctttgtggacaaataatcgaacgaaccattcaaaagctctttttcataagaaaagcataacgcctttgcactaactcccagcgccccctctaaagaggctgttatatcattatccttcccgtctgattctactgtaacaaggttctttgcttctccataaacagaaatatctgcgatataagaaacaccgatacctcccgtaagacgtacactcggaagagtaagctctacttcccctttggtatacactttactcttattaaaatcaaatcctacagagaaatccgctttagtaccagccgttccctttaccttaatcactaccggaacaaccaccacaaacgtctgccattcctgctttgccgttccttttatttcaacaaccagctttcctcctgcagattcgactccgtttgtcttcgtgattgttccttccacatagccataagcctccatttccggttctacgctcatccccatagacgcagttccaaacttagaagccaaaagagagttcattccttttctataggattctttttgcgtttccacaaactttttaaacgttgtccagtccttcttattcatatcctgaacaccgattccaatccggtatgtattatcctccctctcaaaagtaactggaatcgttccataatcaagagaaacatccccaccaccaagaattggaacattctctggaatcgtaaaatctacaccaccgtcaatctcaatatctacattgctctcctctgttctggttcctgtggccgttcccggtttgtcgggctgggtaggctggtttggggtgtctggttcgtcgggttcacttggataatctggtttcttcctcccagatttcatagcatctgagcatacagttccagcgtaggaatagagattggtggatgaaagatttatatgcagggcgggacgcacaccgatatcatctctttcaacaccaacaccctctccttgaccatcaaaatccactgaaattgccatccaatccctgtccggcatgtagtaccaccaagaaacatttccgataaacccttcgtcatcatcactaggataacatctctctgttcccattgcatatgcatatgcactacatcggcttcttctcgcttcatcaccgtaaacatcgttatcaaaatcaaatccatagcttgttgctacatctttattataagatttcgaattagcgagcagaaatactttatcagcaatattatttttactttctgttccatatatattactattgtcatttacaacactggttgttttaatggcacttctttgcgtagatgtgaaagcagaattaataaaattctttctactataatctgtctctggctgattcacagatgcctcatagccgttcagccaacttcgcatactgcttgtttcccatgttacatcttcacaatttgtgttacacttctggtcatctaaagcgatatctgcaagaagaagtgcatcatttccatttctgtttaaaacacgccatttgattggttcatacttaaaataatggtagattttatagttatcattccagtcataacgataaggtgaatcactactggtagcatatgtcgcatcttcccctttaatctgcgatacttcgttcttccaatcgtaatatcattattttcatcccagcccgtcgcattttttaatgtattataaatactgccatctttggatgttatctcactctgcggatagcttccgaagtacacacagtcccaggtaactttctgtccggcatccatagaggaatcctttacgattcttggattgcttatattctctgccgcatttacctttgggagtgttatcgggatatccgcaaggctgactccctgcggacagaatcctgccagcattgctacagataagatgaatgctgttatgcgagataggttgatgtgtttccgttgttttttcataaactctcctcactttctccttgagcatgtttgagaaatgctttctggaagattccgttacaatttgtagaagattttgcctaaatgagggctgcgtagcgggctacgtcaaccgaatgaaggcaaattcaagaatgcaaattgaggcgtgcagatttcaagaatgctttttcaaacatgctctaaaatatagattttgctattttaaaaatagcgtatcattttcttcactaaaattcaataggatgtgtctaagtggttgattttatgacacttttggtaaaagaattctaatctgtagatttgatgtagacgaaaaaagaaaaaatacgatatcccatctgctctgtagtcgcatctgggatatcgtattttttcttttttctgtctaatttaaatccacagttggtaaaaatgggaattctccagaagggcatggtttttctgttcaaaattctgattcaaatactcattgacttttatgtcaaattatgtatataatagtcatataataatcgttaatatatcataattggaggtagcgtaaatgacggattccacaatcttacagccagaaggcttagaacaacgctacgaaagatataaagaaaagataaaacacttcacgataatgaatgacatctttatgcggaatgtattaaagaaaaccgcatgtactgaatatattcttcaggttatcatgaatagaacaggcctaaaagtaatcgaccagactttacaaaaagattataaaaatctccaggggcgttccgccattttagactgcgtggcaaaggatgcagagaataatttttttaatgtggagattcagggtgagaacgatggtgcttctccaaaaagagcccgataccactgcggtctactggatatgaatctattgaatccaggcgatccttttgacagcctgccggaaacgtatgtcatttttatcactaaaaacgatgtccttggatataacctgccaatcaaccacataagaagacgaagcaacgaaaccggagaaatatttgaagatggtcaacatattttatatgtaaactctaagaagcaggatgataccgaattaggccgcttaatgcatgacttacattgtaaagaagcggataagatgtatagtaacgtcctgtctgcaagagtgcagcaattaaaagaaactgaggaaggagtgaatcaaatgtgtcaggaattagaagagatttataatgaaggcgttgaaaaaggcgagcaatttggatttctgcgaggcgaacaatctggtaaactaaaggccaagaaagaaactactcttgcccttcttgaaatgggaatgtcttcggaacagattgcaaaagcagtaaatctttctatagaaactattcagaactggatatctgaagcatcgttttgatttgtagaataaacgagctctccctctctgtatattccaatcctacagatcagttgaaaagatctgaggatggcaacagtaagtagcgtaactattgatatatcataattggaggtagcgtaaatgacggattccacaatcttacagccagagggcttagaacaacgctacgaaagatataaagaaaagataaaacactttacaataatgaatgacatctttatgcggaatgttttaaaggaaatctcatgtacggaatatattcttcaggttatcatgaatagaacaggcctaaaagtaatcgaccagactttacagaaagattataaaaatctccagggacgttccgccattttagactgcgtggcaagggatgcagaaaacaatcactttaatgtggagattcaaggtgagaatgatggtgcttctccaaaaagagcccgataccactgcggtctactggatatgaacctactgaatccaggcgatttttttgacaatctcccagaaacttatgtcattttcatcactaaaaatgatgtccttggatataatctgccaatcaaccacatacgaagacgaagcaacgaaaccggagaaatatttgaagatggacaacatattttatatgtaaactcgaaaaaacaggatgataccgaattaggtcgcttaatgcatgacttacattgcgaagaagcggataagatgtatagtaacgtcctatctgcaagagtacaacaattaaaagaaactgaggaaggagtgaatcaaatgtgtcaggaattagaagagatttataatgaaggcgttgaaaggggcgaacaatctggatttcttcgaggggaacagtctggagaattgaaaaaagcaagagaaactactcttgcccttctcgaaatgggaatgtctgtgaaacagattgcaaaagcagtaaacctctcggtagagactattcagaattggatatcaaaagcataattttaattagcgaagataaacagaccaacaaagaatatatggctgtcagagaaacctatatctcaaggatactttccgcgcttagcgatggtgtagcgaaagttgatgaaaagattaaggaagtcataagtatctggatatgcatagatgccagaaaaaatgaagattccattatagaataccaacttagaccggaagtaaaatttggtgaaaatattcaccccgaagagataaatctgttaaaagggattctcataaaaatacgagctgggaaaaacatgacacagtctaaaaataaattaatcgaaatgttggaatatgtaattgcagaccattcaatagaagaaaaaaagaattatttaaaaaataaatgtggcgtagagatgactaaagaattagaaaggaaggtggaagcgatgggagaaagtatggggcgcgtaatattacagggaatgctagaagatgcctgggataagggagtagaacaagaacgtagaaacacggaaaaggaacgggaaaacgcaatagctgcattcatttcttttggaataccaaaagaaaaaatattagaaaaaggatacacagaagcagaatatacgaaagtaaagagaaagttgctttcttaatatttatgttgagattttctacaggcaagttggcaaaactgacactactagagcaaacttcaaaatttataatgctaaagataaatatctcatcagtgccaatttctcattcaataagtatgcttatgcgtcggcacaatctggcataaaattttgaaagcagaatatacttgaaatatctgattcggtatgatatattgaaatcagaaaagaatatgctgtacagtatgtacacaaacacaaatcccctcagtaccgcgaatactgaggggatttttttgtggggtttggttaccgcatgattttacttcttcttccggccaaaccacttgcgaagtatagtcatgattagttcaacaatgatgccagatgctacacctgccaataccgacagaagaaaagaatatgctgacaatatgtacaccccctttctgttgccagaatggggcggcaacgaggggattatatcatatttttccagaaaaatccatgtaaatctttaatatttcatgtaaattcaatagaagaaataactgcatctaatgatgatttttacggagtttggattacttttatttactattgccaaatatctgtaaatattatataattttacttcaacaacctaaaacagccccgaaagagagaagaggccctatatctgtggccttagaacgaggattgaatgcgaaccattacgcgagcattcaacccacagtaatagagtcgcagatataggacctcttctctctttcggtacgtctgttttgtttcataaatcagataattatcccctcgcaatgatccacctcatgctgtataatctgcgctacccagcctttatacttctgatgctgttttttaaaatgaatatcttcatactctacttctatctcctgatagcgagtcgtttttctaactccttttaaagataaacagccctcttctgcctcatatggttcttttttacttacaatcaccggatttaacattgcaatattcgcaaatcccatattcaccgcaataattcttttatttactccaatcatatttgctgccatcccaacacagccagtttcatttgcttttaacgtatcaagtaaatcctgcaccactggcatatcgtcttttgttgcagggactgctttctttttaagaaacaaaacatctttcataattgctcgaaccataatctaacctccatattgaattctgtttttacttctacagccaaagacagctcgcaaagagagaagccaacctatatctgtggccttagagcgaggattggatgtgagccgttagcgaacattcaacccgcagtgatagagtcacagatataggttggcttctctctttgtgagcgtctactttgcctgcggcaaaccagaacttataactgttctttcgcgatttccacagctttttctaatgcagctttgattcctgctggattctttccaccagcctgagccatatttggacgtccaccgccgccgccacctactaaggctgctgcttctttgataatctttcctgcatgtgcgcctgcttttacagcatcgtctgttgcagttacgattaagttaacctttcctcccatatcggaagcaaggataacaacaccgctgccaatcttgcctttgaggtcatctcctaaggtacggagtgcgttcatgtcaacgtcttttacggatactggaagtactttgtaatcgcctgcttctactacctgatccattacgtcagcaacttcgctcttggcaatctggtcttttaatttctcattttctgcagaaagtgctttgatttcgtcaagcatggactgaatcttttctgctaacttatgaggctctgcctttgctgcttttgctgcttcgtgaagagttttttcctcatcaagataatatttcattactccgtcaccagttaatgcttcgatacgtcttatgcccgctgcaacaccagtttcagaaataatcttaaatgctttgattactcctgtatgtggtacatgtgtacctgcacagaattctttggagaaatctcccatagtaacaactcgtactttatcaccatatttttctccgaataatgccatcgcaccagtattctttgcttcgtcaacactcatgatttctgtgcttacagtgaggtcttcggcgattttttcatttaccattttttcaacttctgcaagttcttctgcagttaatgcctggaagtgagagaagtcgaaacgaagtctgtctttgtctacataagaaccggactgttctacatgatttccaagaacggtacgtaaggatttctgaagaagatgggttgcactgtgccctttagctgtatctgctctctgtgctttatttacagataatgttaccgtatcaccaactttgaacattccctttgttacatgtccgatatggccaatctttccaccgagcatttttacaacatcttctacaacgaattcgccgtctttgcatgtgatgacaccgctgtcagcgtgctgtccaccacctgtcgcataaaatggtgtctcgtctacaaagattgttccagcctgtccatcagttaaagcttctgtaagctctgtgtctgttgtcataactgtaatcttagaatcacattcctgtgtctcatatccaacgaaagtacttgttacagatgggtcgatagactcataaactgtaacgtcagcacccatgtagtttgttgtctttcttgcacttcttgccttttctttctgctcattcatgcaagtctggaatgcttcttcatttacagtgtatcctttttcttcaaggatttcttttgtaaggtctaatgggaatccataagtatcgtaaagtttgaaagcatcctggccatctaactcttttacgcctttttccttcatggattcttctaaatcagcaaggattgcaagaccctgatcgattgtcttattaaacttgccttcttcctgaatgataacattgtaaatgaaatctttcttttcttctaattctggataaccatctttagaaccttcgataactgtcttgctaagctctgctaagaacttaccttcgattccgagtaaacgtccgtgacgggctgctcttctgataatacggcgaagaacgtatccacggccttcattacttggcatgataccatcggaaatcataaatgtagcggaacggatatggtctgtgatcagacggatagaaatatcatcctgctcattttctttgtaagttttctttgctacttcacagatcttatcacgaagggaacggatagtatctacatcaaaaatagatcctacgtcctgaacgataacggcaagacgctctaatcccatacctgtatcaatatttttctgttttaatgttgtgtagttattatgtccgtcattctcaaactgagtaaatacgttgttccatacttccatataacggtcgcagtcacaacctactgtacagcctggtttaccacagccgtatttttctccacggtcataataaatctcggaacaaggaccgcaaggaccagcaccgtgttcccagaagttatcttctttaccaaacttgaaaatgcgttctggagcgattccaatctcatctctccaaatggcaaatgcctcgtcatcttctaagtatacagatggatataatctgtctgcatcaagtcctacaacttctgtaaggaattcccatgaccatgcgattgcttcatgtttaaaataatctccaaaagagaagttaccaagcatttcaaagaatgtaccgtgacgatctgtcttaccaacattttcgatatcacctgtacgaatacatttctggcaggttgtcactctttttcttggtgggatctcctgacctgtaaaataaggtttcagtggtgccatacctgcgttgatcagtaataaactgttgtcgttatgtggaaccagtgagaaactcttcattgcaagatgtcccttgctctcaaaaaactccagatacatttttcgaagttcatttactccatattttttcaaaattctgtcctcctgtagtatctcatatattgctgccggtataccgacatgaaagggtgctgccagaaaacaattggttctccgtcagcaccctgaaatatatcgctatataaattatttacctgatgtatttccagtaccagccgtgttgctttccatgttcttcttcgttcttaacttctttccacaaaaaatgcctccggccgcggctgctaccagcaaaataaacgttatgatatattgaacaaatgcacttaatacagccgacataatgggccctccttcttatactgaaaatggtttctggttacatgaaattagtataccatatttcataaaaaactgtaaaccttttttctgatttaattcggtggatacaacagacgaatcttctacttccgtctgtcagtcaaaatccctacgccagcacctcgttcatgcttcctgtgcggtagccttccaggtcaagagatacataggtaaatccgtatcttttgagtttatctacgatttcttttcgaagttcgctatctaacattcttggaatgtcttctggtaaaagttcgattctggcgatggttccgtggatgcgaacgcggaattggaggaatccattgctgcggagaaggtcctcggctcgctctaccatggaaagtttttcggcggtgatggtctcgccgtatacgaaacgggaggcgaggcatgcaaaggatggtttgctccaggttgggagtcccatctgtttggaaagttcccggatttctgccttggtaagttcagcagcacgaagggggctttttatgccaagttcggtaattgcctgcagacccgggcgataatctcctaaatcatccatgttggagccttctgcgacatacgacatctggtattcttttgctttttgtaagaacttttcaaataagccttttttgcagatgtaacaacggtttggcggattgtgtttaaatgctggaagttcggtatctcccaaatcaagaacaatctgttctacaccaagatttttacaaaaatcttccgcctctccggattctctttccgggaaaaggcaggattttgctgtaagtgcgatgactttatcccctaatgcttcttttgcggctgcaagaagaaaggtagaatccactccgccagaaaaggcaatcgctacggaatccagttcttttaaataactcagtaatttctgatatttttcctgtaatttattcatatccatttctttttattttttatctttactctttttattctttccttatctgtgttttttattcttctgcaagtcgtgtaaagaaacaagtacggtttcctgtatgacaggccgctccaatctgttcgacttttgctaagatggtatctttatcgcagtcaatgtctaaagacttcacatactggtaatgtccggaagtatcgccctttgtccaaagttcctgacggctacggctaaagtaggtcatctttcctgtctctaatgtcttttcaaaagattccttcgtcatgtaagcaagcattagaacctcattggtcttatagtcctgtgtgataactggaatcattccatcgctgtttaatttaaattcgtcaaaagaaagtttgcttttcatttataatgctccttttgtagaaagtacatccgtaattctagggtcgtaagaacaagcctcatccaaagcttttgcaaatgccttaaatgccgcctccataatatgatgattattgcttccatgcattaattttaaatgaaggttcattgctgcgctgtaagaaatagcatagaaaaattcctgtaccatttctgtgtcaaatccaccgactctctctacggtaaatggcaggtcacacacacagtatggtctgccggataaatctactgcaccaagtacgagtgtctcatccattggaagtaaaaagtttccgaaacggcgaattccctttttatctcccaccgcttcacggatagcctgtcccagtacgattccagtatcttcaatcgtgtgatggcagtctacctctaagtccccatccactttacaggtcaggtcaaaaaagccgtgtttggcaaagctatttaacatatggtcaaagaaaccgattccggtatcaatatcatatttgccgctgccgtctaaattcaggtcaacaataatctttgtctcacttgtatttctctctacatgtgcttttctttctgccatttttactcctcctcaaaacgaacagcgatggagtttgcgtgtgcagtcagtccctctgcctgtgcaaatgtctcaatatctttgtgaattgcttttaaggcatcttttgaatagtagatgatgcttgatttctttacaaagtcatcgacatttaatggggagaagaacttcgcagttccgtttgttggaagtacatggtttggtcctgcaaaataatctccaagtggttcagaactgtactctccgataaagatagctccggcatttcttacctttgtcattacttcaaatggattggccgttacgatttcaagatgttcggacgcaatcgcatttactacttctaatgcttcatttaaagtctctgcctctaaaatataaccaaagttttcaagggatttctcgataatctctgctcttgataacttctttaagtatccttcaatttcttcttgtactttttcgccaagtgtcttacttgttgtcactaaaatcgcactggcaagttcgtcatgctctgcctgggaaagtaagtctgccgctacgaaatgcggatttgcagtatcgtctgcaagaacaagaatctcgcttggtccggcaatagaatcaatacttacatgtccgtataccgcctttttcgcaagggcaacataaatgtttccagggcctacaatcttgtcaaccttttcaatagactctgttccataagctaatgcaccgattgcctgtgctccaccgactttataaatatgagttgcaccagcttcatttgcggcaactaaagtagctggtgttacttctccctccttatttggaggggttaccatcacgattttctctacacctgcaacctttgcaggtacaatattcataagtacagaggatggataagcagcttttccacctggtacatacacaccaactgaagctaacgctgtcattttctgtccaagaattgttccgtccggtttggcatcaaaccagctgtttctcttctgtttctcatgatactcacggatatttacaagagatttgcggataacttctactaaagaatcatctactttttcatatgctgccttgatttcttcccctgttacctgaatcgtatcttttgtcagcttacatttatcaaacttttctgtgtaagcaaaaagagcttcgtctcctttttccttaatctcgtctaaaatgccctgcacggttccggcatactggtcgtaattattcgggcttctttttaataaatcacttaaaatattttttgtattttctttatttacctttaaaactctcattttcttttcctctgaaatttttctatttttgtttttatcttttcttggaaatatcaccaatcattatcagtaattgattttttaatatttaatattatttatgccaatatatctcatactaaataatataataatctgtttgttctgctacatcaactcatttaatataaatatgataaagcgatgcaataactaaactagcttatattatttactggcttttacttactatcccctgctaatatttatctctatcaatttgatacttatctaaagtcattagcctattgctgtttcagcttacgcaggtcataaatcagtttacgaattctctcctgttccatcttaagacttacctgatttactaccatacgggcagaaagatcacaaatttcctctaagactgtaagcccgtttgcctttaatgtagaaccagtctccacgatatcgacaatgacctcagaaagtccaacaatcggagctaactcaaccgaaccattcaacttgataatctctacggtctgaaactttttattataaaaataatctttggcaatgcttggatacttagaagctacacgaataagctcaccatgctgtaacttttcccttgcactttcaggtccacagacacacatcttacactttccaaagcccagatccattacttcgtaaaggtttcttccctcttcaagaatcgtatcttctcctacgataccgatatccgctgcaccgtactctacataagtaggaacgtcagaagccttcgctaagaaaaacttaagctttaaatcttcattgacaaaaataagctttcttgtctctttatcacgaatggaatcacaggtaataccaagtttttcaaacatatccattgttttattggcaagtcttccctttgccaaagcaaatgttaaatagcgcatcttaatattcctccctgaattcctgtaatgtctttgtctcctgatctccggaagccatatcataaacagtgacattctccccatctaaatagaggattccttctgctccctgattctttccaaaagcaagatattcttctaacgtctttccttctgtcatggaaacgagttccgtccgcactccggcatctcttaactttacaactaacggaatcgcattctgtctgtcctctgatttataaagaagtaaagaataggcatattcttttaaggaaatgctgatattctgacggcttaatgcagatagtacatcatcaatcaaaatggtaaatccgcaggcacttgcttccttaccaaactgcgctaaaaggttatcataacgtccaccttttccgatcgcatctccagttccataagtatatccccggaaaataattcctgtataataatcaaaatggttcaccatgccaagatcaaaacttacatatttttcgtaaccgtaaagctttaacacttcatacacttcctctagtctggcaattgctgcctgacaacgaggatttatcgtaagcttctttgccttttcaagcatggtaacatcaccatataaatcattatactcaagcagaatgttacgataacaatctttcatagataaatccgataaaagaatttccattccaagagcattcttattctcgatatattcgtgaatctgctccttaacttcctcagaagcttctaacgcacccataattcctttataaaactctgcctgcccgatatctatacgaaaatccgtaagacctgccgcaaggaaacagtcaatcatcatgatgattccctctgcatctgcttccggactatcatcattaataagctctgctcccatctctgtcttctcggtaagcttaccttgataacttctgttatttaaaaatgtattcccgcggtaagaaagacgaagtggaaattcacaggcactataatactttgccacacttcttgcaatagaaggcgtcatatccgggcggagaactaatgtattattatttctatcaaagaacttaaacatctctacagaacttacagttcctgtatcactgttaaatatatcaaaaaattcaaatgttggtgtctcaatatcctgatagccgtaaagctctaatatatgatgaatccgcttctccaccgctgactttctcttacattctgagttataaatatctcttactccctctggagtgtggagcagtttttctttcattaatgttatcctcctaaattaaaatctcattcaccacttttataaaattgtctgagctattctcataaaaaaataattatattacctgttttctcttttaatttataaaaatctataaaagaaagagcctgcattcacagactcttttgtgacaatcttcttgccctttaaatactctgtcacaataaagtggtaacgcattaaaactgtttatgattatactcgtgaccgcccattttgtcaaccagagaacagaactttttctaattgattcctgtaaaattaattgaaattatggtcatccatatctccatccccatcaaattcaacagggtcgatgtgtgttgtcactattacaaggatacaaatcttttacctcgcttgtaatataggaacacaattttccatccactctccctgatgtgttttcatatcgtttctttgcattttcaatttcgtctttgaatcctgttttatatatgaaaattattttatagggatcttcttttccattctcatcataaccgccgataataaccttttcgacaatactttcaaatatttctctatcaaactcttccaatgtctgattttttagtaatgtttttttaaaatctttaagtctcttttgcaaactgttttcactattgtattgttgttccaattcaatcaaatcttggtttgctttaaatatttttttatctaaatctaaatctgcctcttcataaatatctttagcaatacctccatctaaatacttatctaataattttcttctcctatatttcaaattacgaatagactgatctatctttttgattctgtcttttattgaatcgccagacaatgtctcttcaatccgttttataaattcttctaatacatctttgtgatcagaacatagcatctgataagattcaacaaaagctttttctataacttgttctggaatgcctttagcttctggacaaaaacgctttccttttcttatattccttccacaatgccatataattttttcgtattttgaatgactatgccaacatctccttgatacagtctctccacaaaagccacattccaacatactgctgaatgcatattgtctactatatttttctctttttccagtctctactccatttacccgccccttactccggcgctgacgaatttcttgagctttttcaaaaatttcttttgatataatagcttcatggtgattttctatataaaaacggtcttcctcacccatattcgttaatcttctttttgaaatcggatctacggtgaaagactttcctaatagtaaatctcccatatatttttcattattaataattcccatcacacttgaaggagaccaccgatttccatgaactgttggaatttcttgttcgttcaattctcgtgcaatcatagtggaacctgcaccagctacatatctcttaaatatatagcctactgtttttgccccttcttcattaatagaaagtgtttttgttaatggatcataatcataccctagacatttttgaaaccctacaagctctcctcttttcattttcatttttaagcctttttttacatatgcagaggtattttctacttcttgctgtgcaacagaacttaaaattgttaataaaaattctccatccttcaaggtattaattttttctacttcaaaatataccgcaacatttctttcctttaacattcttacatattttaaagtatctaatgtatttcttgcaaatcttggaatactttttgcaattactaaatcaattttaccagatagacattcttgaatcaatctctgaaattcttcacgtatatctgcctttgttcctgtgattgccttatctgcaaatattcctgcaaatacccactgtttattattgtgtatcaaatctgtataatatttaatcatagactgataactcttagtctggtcttcatcatcagtactaacacgacaataggctgctactcttaatctctctatctttctttttgaagaaagttctgtaggtgtgttagctttaattattttaacttccatatcctcgcctttcttgtattcctatcgtagtgatactataattgtattataatacacagaaatagtcaagtagtaatactcgatactacactataatctttttttattgttttttctattaattgatactctttttcgcttataagtttcaactgtaacaactgtttaagcattgataactgcaagctgtatcttagtaattttgtattatccattttctcctcccgtttagctttgaccccaaaagaatgtggcaggattacttaataagtcatatcctgccacacggctttcattgtcaaattcggcataaactatgaaaatataatttataggttgttttgtatacccatttgctgcgtaatcattgcagattaccttaaccataaaattgtatggttccggctctaaggtctatgagccgactgcccaatcagaagtatcattatatctttgctccacctcaccggtatcctggcataagtctgttacatacaaatggcaaaatcatttgattttcaaagtacagttagttatctaagaaagaaagtcatcgcatattcaaactaagcagtctcaaattctaaagtcttagcaatcaattttgcctccaaacgttctcgcaagtcttcatcaatgtagcttttatcaccatctgtccgaattgataatttcactatgtaaggtttataatgctttaaaattttatccatcgcatctacatctccttccgtagctgccttaatcgtttcaaaaggtaataatctttcttcattttttcttgaatctttttgcattgtaactattcctccattcctcttttctccagttcacttttcatcaatttaagtgcttttttcttatgctcatgtattgtactgtttactacacacattattctggcaatttctgtatcgctcatacccaagaaaaatgaaagtaatataacatctcttttcttttgtgataacagatgtaatacttcagcaagtaaatcactttttatccctatgtcatattccaatactttaaacagatgatcatccgatctgtattcatctgatacataaagttcatcagattcttccgatgataaattctcaatagatttctcatgtttttgcaaataatttacataacgataatagtcaactgcttcacctcgcaaaattttataacagtatgcctgaaattgaatttgaatttttcttttgtaagaaggtgattgctccattaaggctcacccccttcctacaaaaagcaacgatttccccctttcattctttatcccgaatgggaccccctgttttttcggttctttttgtaaaaaattatttttttgcaaaaaaaagacgttctgtgtttgcagaacgccataaatattttaacatagtatttattttttaaatagtaataattatataatatatattattagatttttttattaaaatagacattttttcatctcataagcattagttatttctagtattttttttattatctttcttgttaatttctttataaatatttcaatttttagataattaaaattacatctaactctctatttattcgcacacggtaacctatgcgtaccttgacaaaaaagccgccctttcggaccaatgtcatttagataagacattgcccttcggacggctcattttatttttttgattttatcttcgttcttaattctttcggcaattcattcgaccatggtagcagtctgtccaattcttctggttttggaaatgctcctgtctgaagcagtttttccaatacatatgttaaatatagatatggttttaatccacttaaaagtgctgtctctactatactgtaaacaatggcgcttgcatctgctccacggatacttttggcaaacagccagttacggcggcctactgcaaagtttttgattgcacgttctgcactgttattatcaatgctcaaatgaccatcttccaggtaccttctaagatatacttcctgatttaatgtgtataaaactgcatctcctatgagggaagaccggtctatggaagcttccatggaatgcagccactcaaataaagcatctactacgagacgtgattgtttctgacgttctttatatcgttcttctggtgttttatccctgatcagttcctctacttcgtacagtatcccgattcttgtcagtgcctgatgggctaccgtctcttttaattcttacccttacaacttaccctttcttgcactaaaattcattctagccaaaatagtgttaaaattctcatctaatctagggtaaggaatattttaatatagtccatacattataaaaaatataaatccctctttacaaaaccaccttctaggtggtataatcgacttaaaaataaatataaataaaaaggaggtattcacaatggcaacattagacgagaaaaacacttattatattgattatggtacaggcgcaggaaattttgaattcactggtacattagaagaagctatggaagaagctaataagggattatgttacacacaagttccagtttctatttctataaaagatggatgcgatgatattgcttatctcccttggtatggaattgaagcatcagaagatgacgtaataacagctagttttggtaaatttggattttatggtgaatggaggattaatgaatgattacttatgacctatttacaaaattatacggtgaagcaaaaacatatgactctttagaattatatatttcggaacgaggttggcaggactggatggacgactttgatattgaaaccgttactgctatcttgaaaaaaatatatgaatattcaatagaatctcttcaagatattagaacaaaattaaattattcccgtatcgggttatccagagcttattacatcccattaagaactcttgaaaactgggataataaacaaaatatgccagaatatgttgaagttctcattaaatatacatttttcataaaggagatgacaaaagatgaatccattacagaatagaatagatttttgcgttattatttctgttgacggagcaaatcctaatggtgatccagcaacaatgtcatggtatccaagagtattatatgatggacatggtgaaatctcagatgtttgtttaaaaagaaaaataagaaaccgtttacaagatatgggtgaagaaatatttgttcaagaagatagtaggattgatgacggttatagaaatttaaaagaaagaatcttgaactttgatgattttaaaaatgaatatagaaataaaaaacctgattttaaaaaaatttatgattctacttgcaaaaaatggatagatatcaggacatttggacaagtatttccctttaaaggggctggtaataatttatctactaatgttagagggtgcatgtctttatggggtgctacaagcttagatgttattgatgttcaagaaattataagtattaaatctacaaacttaaatgaaacagaagagggacgtaaagatagtgcaagctttttccatcgttatatggtgcataaagctgcttatgttacttatggttctatttactgtcaattagcagaaaaaaataatttcacagaagaagatgctgaaaaaatacatcaagcactaatcactctttttgaaggagatgctgctgctatgagaccagcaggaacaatgaatgttcaaaaagtatattggtggaaacataattgcaagacgggacaatatcctcaaattaaagtttttaaaacacttgatattcagccacaaaaagaatatccattttttactgtaacggaaacaccattaccagatttaactccagaagtttatactctataattcaataataattttctcaaaggcagattgaagatgtatcacattttctttctgtcttttcacttttcatatatcccttaactaaattaacgaaaatcaaccctaaaatccattttacctttcacatgagcaatttatcctctaagcatataaaattaattctagcacaaatagcttaaatttcgtctaacaatctcaggtagagaatcttttattacatcccatatctaatttcaaaaggtataaacttatacctattcacaatttcacaaagagaattcattagaaaacagttatgctgtagatgctgatgaagatattatctttcttgttaatttctttataaatatttcaattttatacaattaaaattacagctaacttgctctttgttcgcacaaaaaaagaaacagccaaacatatatgtttgaactgtttcttcatttctgaagacctctaagcatcgctaaaactgtctcctgttctttcgtgcttaaattgtcccatattttaagtatttctttttgtgattccgttaaatctactggatttttttctctgaaaaattgtgataaagttactcccaaagctgcacatattttttcaagagtaatcaatgacggcagactttcctgcgtcataatcctgctaagcgaagactgagaaatcccggacaactgcgataatcggtatttactgatgtcacgcttttcacacaaagaaattatattcttcgcaacatacttctctatatgcaagtaaatacacctcatttccatcattacattattctattgtacctgtaatgatagaaaattattagatatctactttgcaagtatttagtttcaaatccagaagtatatttttaaaaataaaaagggttgaatagtatattgaaaaaattacacattgccctggatttttaatctattcctattcttttttcgtagtcatttcttttatatctttttttgatacttctttccattcaattagaaaaattggatacataatatgaagcatacatgaaaaaattgctccaagtattaataaacaaattggaataatatacaagaaatttctgcatggtattttatcataaagatatcctaaaatagtcatacatacaatccccaataaataacttccacaagataaagccataagtttccgctcagataattttcttttttttgttatcattttctcccctcccttataacaaaattataccgaataatattagtatagtcaacaaatcaaatataaacatttatttttttatattttcattattttttcttttacttttgttagtcccttccccttattctgtattggaaaagataaaatcggacatgattttgaaaaaaatatgaaaaaattttgttactctacctataaagcttttgatagggtatttagcaaacctcttttacaagttttttcgcataaatgaaatattccttcactaactgcaagcttcagagtatatttagacggtactttcacagaaaattatttttctactaatcacatatgtgagagtaaaaaatgccatataattttgaaaaaatcaaaaaaagaaggagctatcaggaaatagatagttctaaacaggagcatttataccaagtgtcagagaatgctgtatatcttctgaaaatgcattggcagtcataaaaataatcggaatcgtcttttccagttcataggaactcctgcggattgccattgttacctcataaccgttcacgacaggcatctgtacatccatcagaatcatatcatactctcctagatcataatattcaaattcttctaagattttttcaccgttctcacagattgtgcactctgcactttctatctttaacagttcctttaatatctctacattcaattcattatcctccgtacacaagaatctctttccttaaaggatactatcaaccttttcattcttttcttcccgtactgctgaagacacaaatctatcttctgcaattctcaaatctatgagaacctcaaaacagcttttctgccccagttcattctccatatcaatggtaccaaccagatttctggtaatagccattctaagattggttccttgtatcttattagtcacagaaccctcagcatggggaaacggatcaaaaattttacttttgaaatctgctgacatacccatgccattatctctaactaagaaacggtactttgcatagacagatgactttgtctcacattcttctagcagaaactgaatttttcaccttcctgtgtgtatttcattgcattagaaagtaagtttctgaaatttacatcagatgaacctaatcctcgttcatccattcatgctagatgttttcttttgtgacagtaagcgtctgatttttctcagctatctgtgaatggaacatggtattgaatttagtaataaaatctaaaaggtaaaaatctatatacttaaagactattttccctgcttcaatattactcatatccagcacatcattaataattcctaatagatgctgtgataaaatatctatcttctctgcacaaaaaatcttgttttcatgatgatatcacacaaaagaacgatgtgttttattgtgcatctttttatttgtggcatatgtcagctatatagttgacgcgtctcaaaaaattaagtatactatgttcaaaggagataactattatgagctttgagaattattttccactatggaatgacttaaatacagcacagaaaaaactaatttcagacaatttgattacacggaatgtaaaaaaaggaacgatcattcacaacggaaacctggattgtaccggattattactggttaaatccgggcagcttcgaacttacatactttcagatgaaggacgagagattacactttaccgtctgttcgatatggatatgtgtcttttatccgcctcatgtatcatacgctccattcaatttgaagtaaccattgaagcagaaaaagatactgatctttggatcatccctgctgaaatctataagggcattatgaaggaatctgctcccgtcgcaaactataccaatgagttaatggctacccgtttttctgatgtcatgtggctgattgaacaaattatgtggaagagtttggataagcgtgttgcttcatttcttttagaagagacctctatcgaaggaacaaacgagctgaaaatcactcatgagacgattgctaatcatcttggttcccacagggaagttatcactcgaatgcttcgatactttcaaggcgagggtctcgtcaaactctcccgcggcaaaatcacaatccttgatccaaaaagactggaaacactccaaaggtcataaaattgtttttctgtaacatataaagaagaatcctccatttatcagaattatgaaagtcattctaataaatgggggatctttttatattacgagaaaattataaaaatattatgattatttttaataatccataccacatgcatatgccttttcaatcagcgcacggtcattgacaactgcatcatagaagcgaaatccgccggagaagttgtatgtttcatatccatttccttccagaatacgactggcaatataacttcgcagcccactctggcatatcaggtaaacaggctttcccttctcaatttcattgatacgttcccttagttcatctacaggaatgtttttgaatccatccatatgccccatgttaaattcacctacagttctcacatccagtaacacaacgcttttatctctagaaatcttatccatatcttccagatgccattgttttaaggtaccttttgctatattgtctatcatgaatccggccatatttacaggatccttggcagaggaataaggcggtgcatatgcgagatccaaatccttcagctgggttgccttcagccctgcatgaattgctgttgccagcacatcaatacgtttatcaactccttcatatccaataatctgagcgccaagcaaacgataggtctctttttcaaaaaccgccttcatggtcatcacttttccactaggatagtaaccggcatgactcataggagaaagaattactgtatctacctctaatcctgactttttggcattggtttcattgatacctgtagtggctgctgtcatatcaaacacttttataatggagcttccctgactgcccaggtaacgactatcaccgccacaaatattatcagcgatgattctgccctgtttattggctggtcctgccaaagaaatcagcgcatcattacccgtaacataatgttttacctgaactgcatcacctgcagcataaatatccggtacagaggtttccattctgtcattcactacaatactttccttgatgccaagttccagaccggcttcttttgctaatactgtgtctggtgtgactccgattgccagaactaccatatcagcctgaagggatggattatctttcaacaggacctccactccgttgtctttttctttaaatccttctactgtatagcccagtaccagttttatcccatgctttctcatttcattatggatcatggatgccatatccgggtcaaaagggttcatcagctgcttaggccgctggacaatcgtaacatccatgccaagctccctcaaattttctgccagttccagaccaataaaaccgccacctgccaatacaaccgattttggatgattcttatttatatattcctttatccgaaaagtgtcttctacagtacgaagtgtaaaaagtttatcaatacctactccgggaagtctcggctgtgttggctttgcacctggagagagaatcagcttatcatatttttcttcaaatatctcaccattctctaaatttttcactgaaaccgttttacgttccggatgtatggagataacttcatgatgaattttcatattgatatgaaaacgtttaaaaaaactctctggtgtctgtagtgtaagttcttccgggtctgtgatcacgtctccaatataatatggaagtccacaatttgcataggatatgtatccggatctttcaaacacagtaatttcagcatgttcattcagtctgcgtattcttgctgcggctgtagctcctccggctacaccgcctacaattattaccttcatcttatttttccacctttcctgagtaagctgcaatgccaccgatattatttactttagaatatcccattcgttgcagtatcccagttgcctggcggcttcgtgaaccggaataacagtatacaaacagtgggatagccttatcccacgctacagaagcaatattgtcaagttgctgcaacggcacatttttactttctggtatatgtccttcctgatattcctgcggtgtacgtacatccagcagaactgcatcatcagtccttttatattcttctatgccttgattaatattcgactgtttaaagagatcaaaaaatcccattagcacacctccctaaagcatttctaaaatcgcattcttaggtctcgcccctgaaatctgctgtacaatcttcccattcttcataaccactaaagtcggaatgctcataatactgaacttatttgccagttcaggctcttcatctacattaatctttcctactttaatatctctacgctcacttgcaatctcctctacaataggtactaccatgcggcaaggtgcacaccaagatgcccaaaaatctaaaagaacgggtttatcggaattcagtacttcgttctgaaaattatttttattgatattaatagcagacattttacagtcctccttatcttttctttttgtagatttattatagtcttaatttcatttattttccgtgattacatcaccatacctcattaacttaacttcttgccataccatctacacttaatataacacctgtaatgtaactcgcctcatctgaagcaagaaacacaaacgcattggcaatatcttctggctgtccaagacgacgcaatggaattctttcaatcataggttcgataacttcctttggcacggccttcatcatatcagtttctgtaatcccaggtgcaacagcattaacacgaatacctttaggtcctagttctcttgctaatgatacagttaatccgtttactgcaaacttcgatgccggataagcaaacccacttggctgtcccgaaatactcaccatggaagaagttgagagaatgacccccttgcctcttgccaccatacattctgctgctatacgagtagtattaaatactccttttacatttagatccatgactttatcgaaagtctcctctgtataatccataaatggggtgttttctgaaatccctgcattatttaccagtatgtcgacacatccatatttttcagttgcctctttaaaagcctttctgacagactccatgcttgccagatttggactaattccatcaactattgcattgggatatttttcttttaatttatctacagcaacatctgccgattcctgtgaacttgctgccaatacaactgaagcaccttccttcaagaatttatcagctgtagcaaatcctatgccacggcttccacccgtaatgattgcaactttatcttttaatctcatttagaagtcctccttatctttttctttttgtagatttattatagtcttaatttcatttattttccgtgattacatcaccatacctcattaacttaacttcttgccataccatctacacttaatataacacctgtaatgtaactcgcctcatctgaagcaagaaacacaaacgcattggcaatatcttctggctgtccaagacgatgcaatggaattctttcaatcataggttcgataacttcctttggcacggccttcatcatatcagtttctgtaatcccaggtgcaacagcattaacacgaatacctttaggtcctagttctcttgctaatgatacagtcaatccgtttactgcaaacttcgatgccggataagcaaacccacttggctgtcccgaaatactcaccatggaagaagttgagagaatgacccccttgcctcttgccaccatacattctgctgctatacgagtagtattaaatactccttttacatttagatccatgactttatcgaaagtctcctctgtataatccataaatggagtgttttctgaaatccctgcattatttaccagtatgtcgacacatccatatttttcagttgcctctttaaaagcctttctgacagactccatgcttgccagatttggactaattccatcaactattgcattgggatatttttcttttaatttatctacagcaacatctgccgattcctgtgaacttgctgccaatacaactgaagcaccttccttcaagaatttatcagctgtagcaaatcctataccacggcttccacccgtaatgattgcaactttatcttttaatctcatttagactacctccttactttgtttgtagttacattataagcaaaaggtaaatcattttctgtgatattatcacagactatcgcaataaaaaaccctgttgctcacacgcaccagggtttttgtttatctatccttatttaaataatcagaattttattcaacttctgaaaactgatcttttccaacattacataatgggcattcaaaatcttccggaacatcctcccactttgttcctggtgcaataccaccttcaggataaccttcttcttcatcatattcccatccgcaaacgtcacatacatatttcattagtttgtttttccttataaatatattaatacacagcatatattattgttgtatctgaattattttgtaaccttagcacgaatgtcaaatgtttttagcatttccataatccatgcaggttgcaatacgcatatacttcttctaccaattcaccatcgcaaagacaaaaatctgctactggctcctgccctggatttaactgttttctatatattccctgattggtacttaatgtaatccactcaataaaatgctcttcaagcataggatgttttgtctctccgactacaacatgaacatgactaccttccactgtatatacaggtacatgcttctcaacagcagcatctgtcactcctgcttttaattcctgcataggttctccgcaacaaatcacaggtacacctttatcctttaccatttcaataatgttctcacaatgattgcatacataatattttacttccatcttttttatctcctatatttaaaatttaaaatccaattatttctgtaactttttcaaagcagccgccgatttttttaactttaatgcttcttcaccaattgatgcagaaccaacaaaaccacagcctatcattactgctttttttaataatcacttgcttatttataataatctcttctctttaatagttctcttcacgtacttcaaaataactctgtggatggttacatactggacatatctcaggtgcctttgttcctaccacaacatgtccacagttacggcattcccataccttaacttcgctcttttcaaatacctgtgcagtttcaatattcttaagaagtgcacggtacctttcctcatgatgcttctcaatctctcctactgctctgaatttagcagcaagctctggaaaaccttcttcttcagctgttttagcgaaaccttcatacatgtctgtccactcgtaattctcaccttcggcagctgctgctaaattttcttttgtatcaccaattcccgctaattctttgaaccacatcttagcatgttctttttcgttatcagctgtttttaaaaatagtgcagacatctgctcatagccttctttctttgcaacagaagcaaaaaaagtgtacttatttcttgcctgggactctcccgcaaatgcctcctgtaaatttttctctgtctgtgttcctgtgtatttgtttgtagccatttcatttacctccattttttaactactttttcaaaatctgatgccgggtgtttgcatataggacatataaaatcatcgggtaattcttcacctacatattcatatccgcaaatcctacaacgccatattgtctgaccatcatcggtttttccaacttcccttggcttaggttttatattattctggtaatactcatatgtaactgaaggaacattacttaaagtttccatatcggttatctcaccgataaacatcgtatgtgagcctaaatcttctgttttattaacagttacagaaatgtatgcatttgtcccttccgtaatataataaacaccatttgtactcctggcacacttatcaaatgcttcaaacttattgatatttctccctgattggaagccaaaatgtttaaataattcaaactccacactctgactcagaactgatactgtaaattttccagttcttttgatcatatcatgcgtataatttgctttattaacacagatacttagttggtttggttctgaagccgcctgaattgctgtattaataatacatccattgtctttttcatcttccttggcagtcaatacaaacaatccataactcagcttatacattgctttctcatccataattttcctccttgcattttgggtaaatatctttaaatgaaatatcataatctaaaaattcaatttcatgagtattatgatttttttataacaagtccgatatttcgtccatatccacatctgaaatctcaccatattctacacacctgacatggtagtgttttttcaatatgaaatcgaatctgttcggtccatccgggacttcaatctttctaaatgcaccttactctaccaatatatcaagatttctataaacagttccttttccaattataggatacctttcttttataaggtcataaacttcatttactgaaacatgctttttcatctcagatacagtatttcttagcagatctttctgaattgtgcttcttctatttattatccactctcctttattaggatttattattagttagaattatatgcctattttaatctattgtcaattaataacagcaacagctcttattatcataataaattaacattacagactgccttttatttaaattaatcatttaattattcttttttccgttcaaaaacatattctgcatctgatgataaatcagagcggaatgaataacctagtctatcaaatttcttaatatcctcaggattttcaatactattttcagccatgaacctaaccatttcaccacgtgccatcttagcatatgtaccttttgtcaccagtttatctcctgataactcacaaaatacaatcgtaatatatctgtcctgtggtgtcagatacttttctatacattttgagtattcttttgatgcaagattaatgataatcctactgtcatcgattactgagcggtataacaattctccccagtactcatacagattttttgcatctccaattccaacctttgcctgcatttcaagacgataaggagtcacaccatccattggttttaaaatgccataaaacgcagacaagattcttaaatgattttgcaaatactcaaactgctggatttcaaacacagatggtgccatatattgaaatgcaatcccttcatatgctaaaacagccggagtaagcctattataaagatccatattttccaatctgttaaagttctgctctgcaatcttgtcattacatttccagatagctttcagttcttcttttgatttgcttttcatccagtttaatacttctgctgtcttatcaatatagacaggcagttcaaccggtgctaagttatcggtatctacaatcatcttttttgcaggtgataaaataatcttcattatgccaattccttaagcatatttttaggatcatctgccgccttgactttatcatttgcctttataatgattccctgctcatcaataagatatgtagttcttactacacccatagatacttttccataatttttcttttctttccagacatcatatgcttcaataactttacgctccggatctgctaatagcgtaaatgccagtccgtatttttcttcaaatctcttgtgagacgctacagagtccttgcttactccgagaataacagctcccttctcagtaaactgtggataacgctcagaaaagccacatgcctgtttcgtacatcctgctgtattatccttgggatagaaatataaaattactttttttcctgtataatccgataatctatgtattttcccattttgatctggcaactcaaaatcaggtgccttgattcctacttccagcattatttattcctcaccctctgtaactttctctttttttgccttttctttcctattcccggtaatcattttatgacctgtatatatcgccattaccatacataacatggaacttaaagcaaagtatttgtgacttgagtttagctttttatatccagtgtaaaaggtcccaagcattgtgactaatgctcctactgaccaatatttatgtgctttcatgtaattcctccatttttccggtgtatttaattataattatactccgtcatatagcaattatcaatcagatattttttatatttatacagtttgcacaacaaaaagaaacgttgctgtcacattttattgcaacagcaacgaattacatctgtcgatatgaaacaaattggtatcattgccaagaaaatataggcaagaatttctcattccacatcgtttttttagttggaaaatttaatcctcatttttgaactattttgcactctttttttccttacttactcttatatgtggtgtgtaaaagtgtttcggataaaaggcttaatggttctttgaaaaattcattatatatcattccaatttccggattatccatagaatttctgtattgcgcccgttcatcagcctggtataatgatgcgattctcttttttcttaccgcatccgatactggaacacttccacaatccggctgtcctgctccactaatacagcctcccggacatgtcataacttctacaaaatgatatccactcatatcttctgccagaaattcttccgcagccgctgttccatacagaatacaaactttaagattctttcctgcaatcgtcacttccgcttcttttcggttatttaatcctcttaccggacgaagctgataaaaatctgccggtgcctctttcccttctaaaactctgtaaaccgttcgaagtgctgcttccattacaccgccggtatttccgaaaatcattccggctccagttccttctcctaatacactgtcatactttgaaggagtgattttccctaaatccattccttcttctttacaccactgtaccagctcctttgttgtaataacataatcattgtcacgcatttcttctatattaagaagctttcctgcatcacataactcttctcttgctatttctgcctttttcgctgtacaaggtgtcactgctacagaaataatcttttccggatcaatatgttttttatgtgcaaaatatgttttgattactgctccctgcattccgatcggactttttgcagaagaaagatatttcgttttatccggatgaaaattctccatgtattttacccaggctggacagcagctggtaaactgaggaagtggtccggtcccctttaaaattctagacaaaagttcagaaccttcttccataattgtaagatccgcagaaaatgtaacatcaaatacataatctgctccaagtgcacgcaatgcacctaccatctcatcttgtgcaaatgttcccggctcttttccgaagccgtctgcaaaaccaactctgacggatggtgaagtagaaaaaacaacaatcttttccggatcttggatcagttccttcacaatcttataatgaggacgtccggtaattgctttttccggacaaactgcactgcactgtccacagccaatacattgatatgcttccctttgatttaataaatattttgctgctaccccgatttcttcttcacaaaccgcaaaacaatgtccgcactcactacataatgcttcattttttataatcgcaggattcgcatcatctactggaaccataaaaggagtcgttcgattcattagcatatggcatctcctcctttattgattccactatcaattccaagacctgctcttttttctttaataatctcatcaaatttctgtgctgcagcatctacttctgtttcaataataagctggcctccggttaaatcctttaacccttctgtaagaacattcactgctacctgacttcctgttacaaatggtgataatgccagatgcagagggaatccaagtgcaagtgcatatgctccatctgccaacgcctgttcctcaagccactgtggggcactgataacaactggaagctgtggcagatccacattcagttcttttgctaatgcacaggcagccatctcaattcgtccaatcgcaagacatggaccaaagttaagtaccggggaacaccaagtgctgtacatatttctttcaatccttccccacaaagttctactgcatccatcgtcataagtccgcaattttctaaaccaccacaagtacagcctgcggataatacaagaatgtctttcttaattaattctttggcaagttctactgtaaatacatcatgtccttttgctcttaaattagagcatccgacaactgctgcaattcctttaatttttcctgaaacgatcgcatcaatgagtggctgtaaagtaccacctaaagcagctactaaagtatcttctgataaaccggtaatggacttgtcaaaaccatgctgtgccatgacattgacacgcttctctcctttggccggagctgttccatataatttttcttttctgttcttaaacccacatagagcatctgcgataatctgacttgtaatcttttctttttcctctgctgtgtatggcaataactgcgcattagccttctttgccacatcatcaagacaaagcatcttaatatctaactgttcacaaattggctcgattcccggaatcgtacagttaaattcagaaacaaccaaatccacacagccagtcattaataccgcttcacttgtatagttattacctgcatgtccgcagtatacatctttatagcagccggaacgtgcctggtaatcctgccccacacaagtacagcctacaatacggattccctttgcaccaacaagctcagcagacttttgtacaatttctgattctaatttttcttctaagtctgcaaacatggactgctgatgtcctgtaatcataatatttatatattctggatcaataatacgaaaacctaccggatccatactgatttgcggtggtcccataataatatcattcatcaggtttgtaagaatcagtccgtaattacctgtggaaatacctaaacgtaagcactgtaacagcatatccatcggatctgaattcaagtttgtcgatgtctttacaaccgcattaaaaatctcgtcttttgctccacccggcaaaataccaagcttctcccacaattcataacgcttcggaagggcaatatttttcatgagagtcattttttcatcatatggctttctaatatctgcaagaactgcatcagcaatcatctctgccgtcttcgcacaactgttatggcagtccgacccacagttcccacaacagttgatctgtaaaatctttgcaagcttcgcaacggaatccttatattttggtttcttgccttccgcctgtaattcctgtgccatctcttttaatcttcttgcggtattttcaacaacatgcgtataacatcctgaaccggcagccacctgtcttaaaaaattcctacaggcaattgtatctgcatctgctccacatacaccttttggttttgccggtgataaacgacatggaccattcgaacataatctacaacatactccctgtaatccatatccacacttattctgctgcttcaccatacgatgatgtgaagtatccatcggtgcattctctaaaaatacctccagcaccttatccgcactgctgcaaatcttatctgacattatataacctcctcctgatttccctttcattctttcatgaaattttcctaacaagttttcctattcatcgcaattatcccaattcgcagtactcctgctccagagtatgttaaaaaacattccagcacagttttctacaatatcaataattattctcattatagcaaaccaactccattcactcttggataatcctttcataaaatagggaaatataacactaatttttgtcttttcatgattcacaataaaatctgtaatatttctataaataaatggtattatttctatattgtctgtaaaatttatcttataataaaaaataatcgggaatttgacagttatattaaaaaagtaggttgcataaaacctgcattttttatgtcaactctttgttttcttccatgttgttttatgttattgtatagtataataaagaaataagaggattgtttatgaatctgcatatttcaaaatcaaaaattccgaatctttttatattgccaaatcttaccttaaggaaaatgaaagtatttcttctataattatctaaaaacttagaactttattaaaaatctctccttgtaattcctttatataatgaaatcgaattattgtatcatctttcataataatatattcttttacaggatctattcgcttcacatattccgttttcttttcataatgtccgccttgttttcgggcatctggtgtaaaataatatgtagaaatcagaggatgtttatattgggtttgcagtaatatctgtaatttctgatttagctcttctttttcttgtcctgatacctgatgaaattcttccgtagttctagcagtttctttaatctgttctccatatccagttaaagctgcaaatggagcaaactgggctgctctgtctgcaataggcatctgggagtgtttttttgatacgtgatgtgaaagattgataatatcgtcatactttcccattatgctttatgccctcctatctgtccatttcttgttcttgttgttgcaccttcttcgtaacttaaccctcgcaaaactgcattttttccgtattttttcttaatatcaagaatagatttttgtaatctacgttctttttcctgttctttctttaatgcttcataatcagtaaacagatctaactgctgatatacctgtccttctttgggcataactttagtagcagttaatgtgagccgccggataaggagttccttatcaattatcctgtcgtaaagactagaaacagcagttgtaatttcttttagtgaagaagttggtatatccagattaatcgtaccatgtgcgtgtttggggatttttcttccataacggtctgttgcaacctctccactgtatttctgtccttgtagattatccctatcataacctattgtgaggacaaattgctttgaaacaagcttctgttcaaaaagatcaaatgcaatctgttccgccatttctaaaactacaacctttgctttttctgaggaataagcagaagataatacctgtccggaaccgatactttttgcttctggtttatatacttttatatctgcaatcgtgcaaggttcatatccccaggcatggtcaatcaataactcagcattaatgccaaatagtttataaagtaattcctcattatgatattccttttcttttccaacagagcatctggcaacgtctcccatcgtgtaaatctgatatacagcaagctttttggcataacctttccctaccctccagaaatccgtaatcggctgatgttcccataatttctttcgatatgttaactcatccagataagcaatcctcaccccatactcgtctgccggcacatgctttgccataatatccattgcaatctttgcaagatatagattcgtaccaatccctgcagtagctgtgatccctgtttcttttaatacatcctgtatcactttggaaattaattcttttgcccccatctgataatttgtcaagtatcctgtcaagtcaataaaaacctcatcaatcgaatatacatgaatatcctctggagcaaaataccgaaggtatacctgatatatttgtgtgctatatttcatatacaatgacatcctcggagatgctgtaatatatgccagtgcaaccgaaggatcacttaatttatctgaatgaaaagattgtcctataaatttatgccccggagcagcttccagtctttttttattaatcctcttcactttctgtattacttcaaataagcgaggacgtcctggaataccatatttttttaaagaaggagaaacggcaagacatatggtcttttcagtacggctcttatcggcaacaacaagattcgttatgagaggatctaagcctctttccacacattccactgatgcataaaatgattttaagtcgattgcagcatatatcttatccaaatctatccccctccttaaaataacaatattattgatttagtataccatacgtatgttcttttatccacaaatatcccatacttcttaacatatttttctcataaaagtgctaaattttcatgatataaaacgaattactatttgtaattaatattttcattacatacatatcatattctaagttacaaaacattgataactttattgataataaatatagggcatgaaaaaaagccggaagccaccttttatctgtgacttccggcaataaatctatcctttcttcttcctggcaatcaaaactctccgatactgtcgcatttttctgcacctaccagtgtaaagtatcgttttaccaatcatctctagctactcctttcgtttgataaaactagtatactgattagccctcaatacatcaagcaacgcaaattaacattcatgcaacgcccaatattacaaggattcattaagtcctctacaaactggaattgagatttcatatattccaagggatttaataactgttatattttattatcaaatatctctcaatcccttgaaaacacaaagtttatcgcaggtgagctttcccttattgtttcccttgcgttatatcgtcccaccagtgtttacgaactctgataagggcaaaaacaagggcaagaaaattatataaaacagtataacacaaaataaaagtgacattgtgaactgattgaaatgcttctgatttttgcaacaaatgattgatttaacgataaggagatttgatacgatgagaacaatatttgcagaatacaatcccaagcgcaacagtattgatgtttacacctctgttggctatatgctccgcattgactgttgggaagctgaaaagaacttaaaaaccacaccaggatcagactgtgcattaaacgcactcgccattgatgaacctcttgaatatgccaaattatatcttgatggaaatttgcagatgtgggtagatgcggaagactcattagatattttttaatttttaaacaaatacaacagtttaaatcgctattaaccacaatatttccggaaaattcatcataggtttgtgcaaatgcaaagaaacggcggctctgaaaatcaaagccgccgtttcataggcgcgtgaaaatgtgtctgctctgcgacggctttttttcttttgccgtcgcgctgcagataacctattcgttctattttgaacttcttttatgctacctgatgtctgcaataggaatgaatcgccaagaatgtaaacacaaataattcaattcctgccgaaatcaaaataacatgcggtgtccagaaactcattccaccgatattcagataattgaaatctgcaagctgagaaaggaaattgttctgcataccaattccggcagatggaagtatggtagagagccatgttgctcccatcgctacataagcaaaaagcggcatgagaagaactacaatagagatcagcaaaactgtcaatgtgtctttacattttgcagacaggaacaacgtacagctaaccgttgctaatacagaaagtaagcccgctgctgcgagaattatctgcaactgccccagattgatgtttggcagattaatgatagagtatcgcatctgaaacgatgtttttaagcaatccgtcccgaacgctgcatctaaaatcagaatgtgtatcgtgatcccgacaaggaaagtaacaacgaaaagtgtaaatgccgccagaattttggtaattgctaattgtttatgcccgtatttggtggttcgcaggatgctgtcaccgcccgtttgatattctccggcgaaagtagatgctgcgattgccacacacaaaatagcaaggaacaaaatataaaactcaatataatcaaatgcatcttttgaaattccagaatgaagataaaatggcgtatcaagttctgaatatttttcaagagctttctgctgtgcggtttcgttttctctttgctcattccgcatgacatcctgtaaatgttctgcgcacttttcataataggctccgtcaatgtcattcgggtcaatatccattaaatcagcaccaatgcctgttactggatcagcaaacgcttcggacagacccatcagcaagtgacggaacgggacgattttttcaataaatacagccagaggaaagccctcttcctcgactggcccatattctcgaacgcagctttgataagtttccaaagccgatttgatcctatccggggtcacttcaccagcggatgttttatataaatcttgtttgtacttgatagctgccaagccatctaattctgtaaccgtgccatcttcgtttggacggttaataccctcaaatgaaataggcaggtatgccatggctacggaaagcaaaagtgcgattgcaagtaaaatcagggtgcgccgtgacttcaaaatacgttttagttcaagtctaaagagccgcatattatctgtcctccttttccaagtctgtctgcgggaacaaccacagatacagatcttccaatcgtggctccgttgtaacagccccatcaatttccgaatgttcggacagataacgaatagaaacctgattgttatcttcgcctcgctgattgataatgcgcagccgcatttcacattccggcagctttgaggtcggaattatgcaattccaaaccttgccctcaatccgcttgacaagttctgcggtagttccgacatcaacaatttctccggctttcataattgcgttgcgcgtagaaatatattctatgtcagatacgatatgggtggaaatcaacacgattcgatcatgcgaaaactcggaaatgaaattccgcagacgcacgcgctccccgggatcaagtcctgctgtcggttcgtccatgacaagtatctccgggtcgttcaacatagcctgcgcaataccaacacgacgcttcatgccgcctgacagattggagatttttttctttttcacatcggagagcgaaagaatgtccaacaaatgattgatcttttgggtggttgcccttgtaggaatatctttcagcgcagccatatactccaaataatctttgaccgtaaaatcccggtgatacccaaaatcctgcggcagaaagccaaacttgcttcggtagacttcacctaactctcgaatgtcttttccgtcatagtaaaccgctccgttggttggtgtcataatatcagcaatcatgcgcatgagcgtggttttccctgcaccattcgcccccaaaagtccccaaacgccgggagtcaatgtcagattgacatcatttactgctgttttgtctttgaactgcttgcttaaatgctctattttcagttccatgcttacactcctttcttttgcttcagctgaacaataaaaagcccttgttcgataatcattgtaccgaacaaaggcttttcaatctcaaaaatcacacgcttaaattcctaagtaattcctaagatcacattcttattttcctaagcggaaagtggtaatgtaatcacaaagtctatggtttcgttttgactggatgcagtaatctttccaccatgtaaatgtataatttcttccgcaatagaaagaccaagtcccgcaccacctgtattagaaagccgagcatcatccaagcgattgaatttttcaaatatactgttaagctgttcctgtggaattgtttttccatgattttcaaaagtgatctgaatatcatgctctaaccgtttggcggatatagtgatttctgtctgcgggtaactatatgacgcagcatttcgtaaaagattactgaaaactctcgccagtttttcagggtcagcgttcacggataagttatcctccgcagtaaataccgctgtattgccatttgcggagagtgtcggatatatttcatctattacctgcgcaatcagacaatgtaaatccacagtttcttttttgataataaccgtatgtgcattgtacttggtaatttcaaaaagttcattgatgagcttttcaaggcgctctgccttattcaacgccacttttacatacttttccttttgctgttcaggcatgtcaggggcttcatgtagcaggctcaaatagccgattactgttgtgagaggggtgcgtatatcatgtgccagatacataataatttcatttttcttttcttctgcctgctttgcagcctgcttgctcaacagaacagacattttaatctgattgagctgttcctccagttctttcagtggctcagacaacgatactgtatgattgttctgctcatagaccgtttgggttgcgtcaattacttcatccagatagccccaaggctttttccaatagtaattgaagatacatataaagccgagcatcagatacaaaataaaaagcagatcaagccgccagtagagccatgcaaaaataccgttgtcaaattttgaaaagatgtagtccaagataagggtcaaaccatatccaacaacggtataaaccagcaatgataggtataagcgcactttaaggcgcttttctgttgtcatttctttattcgacatgagaatacacctcctaccgattagcaaacagaagaaagccaaacagaccaatcacgacaacacttactatgcctgccagaatggaaaacagtctgtttgcttttattctatttccgattaaccgggctgccatcgaatatacagcaagccccaaaagaccacctgccgtatttgtaagtacatcagtaatatcagaacgtccgactgctaagatatactgcatagtttccaataaaaaacttgttccagcaatcagcatgaacttcacatataattttgttcttggcagaagcatttgaagataaatgcccataggaacaaaaatcaagaaattttcgagtacctctgttaagtgaaatgctgcgccaacttctttgtcatagtgaaaaggaataaggtttatactccttactttatccagatcactgattgaaaactgtagtttgaacagtatgatccaaaccagaagtgccagataaattaagaataaaatagttgccaaacaatttgattttctcttcatagcgttctcctttcgcttaaattttgtagccgacaccccaaatcgttttaatatactgcggagtatcggaagtatcgttcagtttctcgcgcagatgccggatatgcacagtaattgtgctgctgtttttagagtagtattcatctttccaaaccgcatgaaacagttcctcaatgcttacaacatttccagcacttgacaaaaggacgtggagaatagaaaattctgtcggggttagagaaacaggttccccgtctaacagacattcatgggtctgcacattcaagcacaatttgttataggaaagttccgatggaattttctctgtgatgataccgggtgaatatttcttgtaacgtcttaactgcgctttcactctggcaactacttcaagtgggcgaaagggttttgtcacataatcgtccgctcccaatgtcagccccgttattttatccgtttcctcaattttagccgttagcattatgattggataagtgtatttctttcggataagctggcaaagtgaaaagccgttcatatccgggagcataatatccagaatggcaagatcaatgtcgccgctttcaatacacgacatggcatccgttgcgcagtaaaatttataaacgacgtaattttcgtttttcaagtagacctccaacagatccgctatatcttgctcgtcatctataatcaatatcttttcagacatattttcaactcctttgctcatatttccaattaagtatagcaaatacaacatctaaattcacaatggattgcctgagaaattattaagattttcctaactttcgaatttaggcaactcaaaatgctaacgtaatttacatatcagttttttatgtgtcatacatattctccaatatacttccatataatgcacagattgacttcacaattgcatgccatgaaatatcagcagcataagaataatttttttgatatgttttccataaggtctccataaccggacttgattcaatttcatcaaatatttctcttatatcctcagcttctatcaggtctaatgttcccctttttttggctgtagccacaagtgcagtccataaaacttgtttttggagttgttctccatacaacttttgtaaaatataaatatcataaaaatctctcattcgtgtatttgtaacgtttcgactaacaacagtttccaatttttcagccaataccgtttccagattatatgcccatacctcaatagtgcggtcttcaagcataagattaaatttgtacttgatttctcttggtgtaattacatcccctgtagaaatatcaatctttaatggtgtgattacaccatcaaatttcgtttccatgcttacacgaacaccaggataatctgcttcttccatgatttccgatatccgtttgacccgaaatgaaacaccatcgtccagtggaattgatataatttgggatataatcatttctacatcctccacactaacattagtgccttttatggtagcatccagatccatagtagctctggcatccagaccaaccattgccgccacaagcattccaccttttaatataaactggtttttatactctgataaagaaattcgttctaaaaaacgttccatcatataattccgcatcaaaatctgtgcatctgcggattttttctttgacatattacgaattaaatcctttaattgtcttgccgttgttatcatctaaagtaacacctccaaatatggtctaagtatgttttcaacatgaaacatagctgcgtatttcataagcatccgtaagtttttatccttacgttttgcatattgtttcaatgcgtcttgaaagacctgcatttcaacattttttctgctacgaagcagatcacaaattgttctctccatgtcataaacgggaacggaatgtccgaatgatgtctgcatagctatgattcctatttcatgtaaatccttttttactgtgtacacttgaaaaccgtcttcctgcaaacgacttggattatatccagttcttactgttatggtgtatttcaaaggctctctgtccgttaaatcatgaaaaaacaatgcagtttcatgagaaaatacagcttgaccacaacgtaaatgcaaaaggtacattgcatctgtccacgtatccggcgatacatacacaccatgagcagcttgttctaatcctcgttccttcacatatgcataaaacacagacttactaattccattatttagaacttgaaatgtctgaattgtccctccacattcacgcaacaacaaatctaatttttcaaactgagtcatatgctttctcctttcgtgctaatatgataatatatattagcacgaaagtaaagacatatagtaccaataaagtatcggtatttttgttttaatgatatccccttgtttctcgccatccctttacataccacctgattccaacatataccagttgcacgaataataagagaaatagcagattgattggcaatgttgtctttatccacttcccaaagtagatagctgttgccatgcttataagtattaccattatggtaatcatatcccaacagcacttcttatataactctgcaatctttatctctataaatgctacaagtattccagcacccaccaaacatccaccgcagatcagtattcttatcagccaatatacaattccggcaacgacaggattggatattccattactaatctgtgccatgttctttcctgtcagtataatccaccctgcaatggtctgtataaaagtggcgattgtatcaaagaataccacgcaatcagaaataaatatttttgaccgtatcatctgaaaaagagtagttgatacggaataccatatcagcagaaacatcaatgcttcatacatggctgtttttgttttatatctgcctgccagtttttctctctgcgtatcatacttttccttggctttcagataagctgtcaggttacagttcccacacttttgatagagtactggcttttcaaccggtatctctacttttttctgatgagagagtgcatagtcccgttcctgttctgcctgccttagcttatcttgacattcctctgtcatgatttcggcagcgtgcgttttctctttctctctctgcaacaattcttttgttttcctcaagtcgttctttaaggcttgaatgttccctgctctgttctcgctgtttaacctctcgttcaaggtcagcgattcgtcgagctgcattttcagttcccggatagtcctgtctttctggtcgagttcttcctgcatctgctctgtcagcagaagcaactcttccagttgatcgtcgctctttgagtttcttaattcgttcatcaatcgaccttcctttctctaattgctgttcaagttcagtaattcgctgttctgtttctgcaatagccggttctcgctgtttaatttctgtgccaattcctgccattgctgattttcgtctgtaagcttctgtatctggtctgtcttttcttccagaagtatcaacagttcttctgtatccggcaagatttgaagcagttctgataattcgctctctaattgctgcaatcgttcttccttctcctgaaagcacatcagcttctcgtccttttcctgtatttcctgaagcatctctgccatgatattctgctgttcctctatctgtgtaatcattgcttccatcatgggaattacttctttgctttcttctaatgtcattcaaccactccttccatattgacaatgcaccggataccttaccaaaggttgtgattaccttttgcagtagtgcattttgttttttaatcatctggttttcctctaccttccatgaaccattccatatctgtccggtgagatatttttcctcaatctttcttgcatccgcaccctcatgaatcgtagggatttttaatttgccctgtctttcataagagcggtggtcaatctgattgtctatggataaatgccggttacacatcccagcccattcgcttcgccataactcacaattctttggattattccagccggtagcatcggtcagaacccgtttccattgttttcggtttcttgccccgactttctgtactccgttttcatcaagtaccggaatgcggattccatgccggtcaggatttttcttatcctgccaccagtccgggtgggattcatcaaccacgatatttccgtcagtatctctgacaaaatcccagtccttgacttctttgctgccccatgaatgatccagattgaatggtcgcatggttacaagtaaatgcacatgtgggtttccatcgcccttatcgtgtatgctccagtcgacacacattcccttatccacgaaagtcttttgaatatattcggttgtataatcaatctgttcctgtctgctccattctttcggcagggaaaattcaaatgagcgtccaagctgtgcatctgcatttttttctatcttcaatacctcattccatagacgctgtttctgaaatgtgattttaaacttttccagtgcggcatctttatcatccgctcttttataacggatagactgttgaaacctttttatattttcttccggtacatgcagccattcaggaggtgcattttcgcacatcatcagactggtgtagacgacttcctttttggaagtatagtaactgattctgcctgtttcctcattcttcatcacatctccattaagatatgccgatgcggatatgacagattttcctttactgcgcccgacaatctttactgtaaagtgaaatatcgccatgatacgattcccctttctgccgtatccggcattgatttccgacagcatcttcttctggtttggcagaagtgaagctgtcggaacgccctctgcgcaagagtgccccctgcggcatgagcaggtctggctgaaagccccgccgacggaacgagcccggcaagcgtaagcgcagaccggttgccacttgtggcaaacttataaggacgacctctggttgtccataagtgcgcccttcattcaaaggcaatgaagggaatggaaaaaccactccctccgccattacacttcctccatatctgtaagtggctctttctgcatcgcctttgagaaaaactttccgtttgtttcctgcctttttaagaagcctatcaactttggtaaatcttcctcctcaatcggacagccaagaaccgattccactgcgccaccaatctgacagagcctgtgggttcgttttttactttcctctgctttctttcgcttttccagttccttccgctgtgcaatgagcttttttgtagcttcaatgctttcctgttcctttttctctaatgcacgtattctttcttcataagtctttgttgatttcgccatatcgtcttcatcctttctttttccgataaacaacagttcccggttgcatatcaggagaagcacatggtataatcctcttgcgtgtaggtatatcatggcttcggtctgatagaacctttggcggtttcttaggaagccgcctttttaagttgccacatttcttgtgacagcttttacatttcctttatccctcagatcacgcccctcgttggcttccatgaacttttccagaatgtcagttttaataaggacttttcttccgacctttaataccggaagcttcttccattcaaccagctttctcaaagtgtttctgccaattcctgtatagtcggctgcttcctcgatggataatgcaatctttctttccgtcatcttgtcacctccttataaattgcattatgcaatttttgttgtgctgttagtatagcggttttatattgtgttgtcaagcgttatgaaattttaaaaataattattatattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttacagcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgttgttgatgttaaagcaatataacctgtttctggaatcattccagtttgcctgcaagaattacaagggcaacacgaatgaagctgatattgcaaaagtaatggggtttgaatcgaatgatgaatataatgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggacgattacgaaagcaagaaattcattgcaaagtcggaaaatattacaattggagaattacttgatatatgggcagaggaagaattaaagaccggtacgctcagtaatgggacagtccagaattacctcggtgccattaccaacatcaagaagcatccaatttcagagagaaagttgaaaaatgtaacatctgagcatttacaagccttcttcgatctgctttcctttggtggcacttatccagatggttcagaaagaaaaggttatagcaaagattacattcgttctttctcggcagtattacagcagtcattccgatttgcagtatcaccaaagcaatatatcactttcaatccgatgcagtatattaagctgaaataccagacggatgaggttgacctgttttccgatgatgacatggatggcgatatacagccaattccacgagaggattatgaaagactgattgaatttctacagaattacaatccaccggcaatacttccaatccagatagcttattatgcaggacttcgtatcggtgaagcctgtggtctggcatggcaggatgtgaatcttgaagaacagtgccttacaatcagacgcagtatccgatatgatggttcaaggcacaagaatatcatcggaccaaccaaacgaaaaaaggtaaggattgttgattttggagatacactggcagagattcttcgcaatgcccgaaaggaacaacttaaaaaccgaatgcagtacggagaactttaccataaaaactactacagagaagtaaaagacaaaaacagagtttactatgagttctatcatctggacggaacagagaatgttccagaagattataaggaaatatcctttgtctgcttaagaccggatggaagtttggaactgccaagcacgttaggaattgtttgcaggaagattgctcagaaactggatggatttgaaggatttcattttcaccagttgcgacacacctacacaagcaaccttctggcaaatggagcagcaccaaaggatgtgcaggaactgttagggcactcagatgtcagtaccaccatgaatgtctatgcacactctacaagaaaagccaagcgggaatctgcaaggttacttgataaagtggcaggcaatgactaaataaaactttcccttatttcccttacgattatctcataagggcaaaaataagggaaaatacatatcgtttcgctaatgcacaggctggaaagcctgtaaaatagggaaagttagaaatatatttcggcaaactggaatttgactaattattgtgttttaatgattctataaactacccccaattgagcagggtatgtttcttgaatcattccattaaaccatattgtaacgatatctcccacctgaacatcttccgctaaattttctgccgatacataatactctccatcattcatctgacaaaagccttcagctgtactcacatgcgttacaagaagttctccatcatcggtaatttcttttacttttgcattaaaattgataacctctattggaatagacgtatcatctttttcaatatctctaaatatgattcgttcgtcatcaatgactactatgagctgaccttcagaactcctttgataatgatatccgcttccgaaatttgattgattattttcagatggtaactctgtccctgccactgttgacacaatttctccatccattgttccacaaccaggcattgacgctacatatcctgtgtctttatatataacaccatcaaccataacacatggaggatatgagccagtatctgctgtttgctcattttgtactacatcatcattttctttattttctatttctacggacacatttccagacacaggttctttattttcttgattcgttccacatccagccattcctagcaccatacataatacaagcagatagattacttttttcataatacatgcctccttaacttatattttttaactctataaaccggaattttatcagcaaccttcttttttatcttttatatcgtcttttaacgatttaatttcttccagaatgagttcagtacaaacgactaaaagacctgaaagaagaataattccaccgtaaatcggataaataaaagattcttggactccaccgccaatgataccagacaagagttgccacacaccactgaacggccaaacaactaatgcgaataccacaatcatcgtaataatagcttttttcattgctctttacctccgtaacttccgatttttcgttctctgtgacttcccaataaacgggaagttatggctttaacttcctacaaataatcagctttaggataatacatacgaccaccacaacagccaccaaggcaccacccaatagcaactctgtgtaccacggtgcagactgcatggcatataaatttggataggttttaaagtgccagaacttataaattccgaacccaatgaaaactcctatgaatgaaccaataacgatgttaaaaaaggaattcaactttttcagcatagcagtgcacccctttccaacttccgatttatccagttaagaaaactggaagttatttaattctctgtgtacctaattgtaattgttcaactgctatttttgctttattgtcatcttccttttggagattttctatttccgaactccgaatagtcaaaatgatttcgtccccaacctgtaaatcatcaaaagttatatccacaacatcttgtgtatcataattacaataaatcataggaattttggaacaatcaataagacaatcattccctaaaacaccttcttctccgctatcttttgtggttatgattctattttctttatcaatttctgttattatcgcattgacacctaaagtaagtggttcgtttgtttgttgtccagaacatgcaactaaagtaaacacacaaataaatatacataatgccattatcatttttttcatcacaagttcctccaaattccgatttcacgacatcatttctaatacagattatactatatttttttaattcagtccacgcattatgcctaacaggtatagatgcctgatgcaaaaataatatttaattatcctcatctcttatttttgcgaccatcaacactctccgatactgccgcattttttctgcacctaccagtgtaaagtatcgttttacatcctgatcagtcagaccttcttcaatgccttttataatctcttcctgttcttctggtgatagctcactggaatatcgtctaaagcaatcaataatgtctcctgataagtcccattgttctctatcctgtagcatatctggctgctggtctgtctctttttcttcctcttcgtttacctctgcaacttgtatttcttttaccatcttttccagttctctcaggcttggctgtggagtttcattgaagttaaggtaaaggaaggcttcttcgtctatctggaacgtctgaatattggaatcttcttttgctttttcttcaaaaaatgtaaactcttcttttgaaatgtaattcaatcttgactcaaaacgggttgtgatatatattttttttctttcatcataggaaacatatactggatttttatagccattttgtccggctatcttctctgcttctttaaatacctctgtattaaacggccagtttttcttatcgtagatgggacgttctccctttaggaacaggatgcagtcgtttttcggcatccggctgatctgtcccggagtcattaatttcattccggccttgctcatctgcagattaccactgccttgtgaatgtcccaggctttcggaacggctgtcgatcgtcatgtcctctaacatatctgatacccactgatgcgttgtatgggctgtagctccagagcctaagaatacggtcgttgcacagtttcctgtgaatatctcccatttgtcattaggatacaaagtttttatctgggcaatatcttgcagaatcggtacgatggacatatttctgcttcgtatttccccaagaagtgtctcacagttaagtggtttaggaccggcatagtattcatctgcccacagccgtacatggatcggtaactgtccgtctcttcgattatctgcgactctttttaaaacggtaaataactgtgtgtagaacatattaataaaaaggttataagaagaatctccagacggcatgacaagaaacaaagctgtttttttcttaggatttccctctacacctaatcctagtgatggaatatctatgtcatccgttccttcaaatatccgtttgatctccgggatttcaaaaagacgtaattgtgcattaaccatgataacaatagagcgtacggtttctgatgcaccttcttttaacttgcggtaatctctcactggcggataatcttccccatatctttcctgtaactcttgcatatcctgctgtaactgcgttgtcccttcttcatctgttttttgtgtttccttgtttaccagatcaaggattcccagcatagaggctgtccttccctcttcttttgcctgaagccattcatattcaaacagggattgcagatacagtcctacaccatcatcccagaaagggtctcctttttgggcatccggcggctttacagatgtctggatatttgtaatgagttctaccatatccgtataattttctatgtatctgaacggattatactggtctgattgtgccatatctttaaaattaaggctttttacagctatccctttttcttttaagtagcctccataatttttcagcaagtctcctttcacgtcaaggataatatttgtcatattcgccagtaagatattcggaatcaaaagggatgttgtttttccatcaccagaaccgcccagaatcaggatatgcatatttggcaatgcctttgcatttactgtaatatttttactcaggcaggtaacaggttcttccccttttccatacagtcttttagctgcctttggtacatctgcccattctgcaacaccatgttctgcatcgggatgaaaattgcggtaataagtgagatagtaacagacaaacattacccatgcagtcagggcaatccctataacggctggtgttttttcattgaaccagttacggaatggatgcatcaatatgtaggctaatttatcttgataattctgtatcgtcacatcatctagtttgaacaatcctgctatataatacgacactgccaatgctaaaaacaacaggataaaaaacatcccccatggtggttttcgtttttgtatcatacatattctcctataataaaatgagcagaagaacgattttcttctgcccatataaaaaataaaaacagctatgcctgtttatacataactgtttttagtaactgctggtcaccgtactgaaattcagcacgttttattttgatctgattggtggatccggcatctttatcttaaggtcacttagatcttttcccttctctttatatttttttaatgatgttactttacgttctgaaggtctgtctactttatcaaaatattgtttcgcaaattcttcgcccgtcagttttctcatctcatggtctacctgttttgttctgacattaaatacaaataccggctcttctttatttagaaaagcgatatacgaacctttttgtgtctcaaagacctgtgtttcaggtatcacaagttgtttttcattctttccatatgtcccaggaatacggcaggcaaactggttatatctatctaatccatctttattgatcactgaggatttctcaaccagagtttttttatcaatgctgatcgggatataggcagggtcatttacataccgcaaatatgctgtcgaagattcttttcccatagtgttatattcggctgcttctatttggtgttcgatctctcccttttcttttccctcatatttagcattaacagcctttaattccggggaagctgtatcaatatattctgcttccgtctgctgtcctgtctgcatatagttatccatcgacatttttttcatatccgggacatccgttatgccatctttccgcagatcatcccggtataatttataccaagattcaacttttggaagatctgcatttgctataacaacctgcaattcaccatctccaacatgtaaatcaggaagtcgagaataattaattcctaacttttcaaaatcctctctaattaattcctcttcatcttccagtggaaaagaaactatcgttgtttttccggaagtaagattccttagttcctgtatgtctttttctccccctgtcatacagcttaagatatgccgctgataccatgccccaaaattttccctgtctggctgataaacagcaacctgcagcattccatcatttttttccagatcaggaagtatcatataatggatgccgagggtatttaattcttctgacaactgttcctccgggatttccgggacgttcataatatcatattttccttccgtcattcttaaaaatttctggaagtccgtaaattctgtttcttttaattttcgttctttgaccatacgggcaaaatactgcagtaataagatagtccccattgctgataatttaaaaaaagggtccatataccttgctgcattggatattgccatgacaacttccctgcttttttcttccatgcgtatctcctcctgttccgtactgaaattcagtacattttctataataacttcggtacagattctttctgtattttgtttgtaaagatatgcccttgcttctgcatcctctctgtacgttctctttccggcatatcttttcctggcagtccatatttttcctgtatcttttccatatccactccgatctgtttattctccttttgtatcccttccagatagtctatggtctctttcataagctccattaattctgtctgggacacccggcagtggatctcaccatttaacaggttgtctgcatgcacgtttaggatataaccaagcaaagtgacggtcatcttgtctggttcttttataccattttccatgcattttaattcctctggtgacagcaggatacgtcctgccagttcttctaagctccacccccgttcttctcttaatttctggatacattttcccatttttgatactcttattacaggcatattctctgttcctcctgtcgattcttcccatctttctgtattttctcttcgtctgatcctacatctaattccgcatttactttgaccagacgagcctggataaacttcagttcttcttctttttcaaatggtttctgtacttctttttttgcctgcacaagctgctgtcttgcatcttccagccgttcttctgctgtctttttttgtccgggaaggtttctcattgcggtaaggatacgttcgatgtttcgtacagggtcttttttaacttcgactatgaaagaggcttctctcgtcagtcttacataaaagctgttgtcaaacaaagaatacgagatcttcatctgaaacccccaaaaacttccgatattttctgcatcggcatgggctttcttcatctgtgtacaggcctgtacaagcatttcccccgcagctttttcatcattataggtaacaccatgtatctccatcaaaaaaggagtgttcaggacggtatctatatgttttatatcagtatcatatgctgtggtgagttcttcatattttgcaatcttttccgggtattccacagcaatagcatcctgcagacgaaacaggttgctctcataattggctttcagcatctttaactttgtcacttgtacatctaaatccatcttttcttttatcttgggattacctgttgcaagtgccttgacttccgcataagataatgctgcttcatcgacatcctggcaggaacggacaggggatttggatgtcatgatctgcccgatgaacttctgtttattttctataagctgccaagagtatgcgtcaaatgtattttctgtgatataccggaatatctttacttttttatttttatttccctgtcttaagatacgtccttcctgctgttcaatatcagcaggcctccagggtacatctaaatgatggagggcgatcagtctgtcctggacgttagtaccagcacccatttttgacgtggaaccaagtaaaaaacgtacctgcccggaacgcactttagagaataatcttgctttttgtacatccgtattggcatcatggataaatgcgatctcttcttccgggattccctttttcatcagtttttcttttaaggcatcatatacattaaaggttccgtctttctttggtgtggaagaatcacagaatactaactgtgctgccttctgtccttttgtttcttcccagattgtaaaacatcgctctgcacaggcagaaaccttattattttctgtatccggcagcatatcattgagaagcctctggtctaaagcaagtttacgtccatccgttgttatctttaacatgttgtcttcacttgggtctaccgcaccattccgcaccaactctgctcgttctgccagggactgcaggatctctttctgctgttcacttgccggcaggacaatattttcatattcagcctgtggaactggaagttttaacatatcggcagtttgaatatctgctacttcctgaaaaacagacattaactccggcaagttaaaaaagtttgcaaaacgagttttcatgcgataactgctaccctctggagataactcaagagctgtgattgtctccccaaaagtagaggcccagttatcaaacatccccagttccatttcctgcaggcggtcatactgcaggtatctctggatagtatacagctctgtcatactatttgagactggagtccctgtcgcaaaagtgatccctttccctcctgtgatctcatccatataccggcatttattgtacatatccatcgctttctgggattctgtttgtgcgacacctgctacattcctcatttttgtatataaaaaaaggttcttaaatgcgtgcgattcgtccacaaacagcctgtcaatgcccaattcctcaaatgtcaccacatcgtcttttttcttatcatttaactttgccagtcggacttccaagttctttctgctctttaccatctgcttgatcgtataattttctccctgtgcttctttagccaggctgatcgccatctcgatctcatctatctgttcttctaaaatattacgctgccgttctgctgacagtgggattttttcatattgtgagtggccgataatgacagcatcatagtcccctgttgcgatccttgcacagaactttttacggtttgcaggctggaaatctttctttgttgccacaaggatgttggcagcaggatacaaggtaaggaattccgcaccccactgttccgtcaggtggtttggtacaacaaacagtgatttatgggtaatcccgatgcgttttgcttccattgctgcggcagccatttcaaaggtcttccctgcccccacgcagtgtgcaagcaaggtattatcaccgtataattggtgtgcgacggcatttttctgatgtggctttaaggtgatctccgggttcattccggggaattccaaatggcttccgtcatactgtcttggacggatggagttgaatctttcattatagatcgtgaccagcatttcccgccgttccctgtctttgaatatccagtccttaaatttttctttgatcatatcctgcttctgtcctgccagtattgtttcttttttatttaattccctgtgttcctttccctcactgtcagtataggtatcaaagatctgtatatttttaaggttcagtgaattttccagtaaacggtatgcattggctctcttcgtcccataggtattggtcgctaaaatgctcccatctatatttttcccctgaatattccattcccctgtgtaagaggaatactgtatctttatcgtatggtttgcggcaatatattttggcggctgaaatgtctctatcataaattgctcataaacttctaatggtatccacatagaacccagccgtacttcgatctctgatgcttctagccgttttggctgcacattttttaatgcctctacattccttttatactctggagtactttccaaaaaattttctgcaatgcgaagtttttcccgtacattgcctgacagatagctgtctgctgtctcccattcctgtgttactggatttctatagataactcctgccagttcttctgttatcttttcccccggctttccacaaagtcccgacataaaggaaaggtcaacttttccatgttctgtcatagacacagcaagggcttcgttcgcagtattgacatgagtgatactttccttttgccggatagtacgtttggagaacatatctgcttttccggcaagattcccgtcttcatctaatctttcaagggaacataacagaggataggaggaatcttccgaaaaagccctcttgttcgctatgctgtttaaaagtccccattcttccgtataagaatcatacagggtattcaattttctctgctctgcctgaatctttgtttctgtattttctgtttcttctacctgcagtcggatcagttcccggacacagtcccggatagcagccatcccggtgatacggctttttgttgtctttgtgaccctttgctgctccagtcccgattcatttttataataaatatccccagcttctgatacgacatagctgtatatcctgttcgcttccctgtctggcatatctgttacaggttcggtcccgtactgaatttcagcacgttcctccggcatcctttctggtatatgtcctgtgatattggctatggcatcccgtaattgtatttctaaagaaacgccttcgttttctatgcaggcagtctccaccccataaggtcctgagatttctttcattgttcccaggatcatctccgggtgtgctgcaaaataactatttacagggatcccctgtgcatcctctgtaacagagatccattccgaatcagctatttctttttcccttttttgcaggaacaaaatatcagaagttacttttgtccctgcgtttttaaatgcagtgtttggcagccggactgctcccagaagttctgccctcttaaaaagatattgccttactttggtattttccttatccatcgtcccttttgttgtgataaatgcagcaacaccacctgggcgcagtttatccagtgtctttgcaaaaaaatagtcatggatcaaaaatccatgacggttataaacagggtcatttacccggtaatccccaaagggaacatttccgacagctatgtcaaaatatccatctggataatctgtacgttcgaaccccgtattctcaatatttacttctggataaagataaccagctatctttgcactcatctggtctaactccacaccatataacgtagacttgttcatgctttctggaagaagtccgaagaaattccctgtcccacaggatggttctaatatccgtccctttgtaaatcccaggcctgccaatacctgatacatggctttaatgagaaccggctgtgtataatgggcatttaaaacagaccctactgccgaacggtattcttccggagtcagtgccgtctgtatcctctccctttcttcctgccactgtggtttcttctcatcaaaaacatctgcgatcccgccccatccaacgtaatctgctagtatgttctgttcctcttttgttgcctgccgttgttccttttctaactgttttaccgtttcgatcgcaaggatattcttccagcatttttcccggattgtccctgtttccaattccccttttaaaatatgatagttctggctgttctcttctgaagcaggagtgacagcaaccgtctctgcatcgaggatctcttcctggacttctgtagcagtgatcttatcttgtcttatttccgcggcccagtccatgatctcatcataggagatctgcctgatctcttccgcatgatcttttatatattcttttgcttccccgatactatgaaagagcatctcttctgaaggatacggctctaccccgttctttccttttttcagtaaacggtatgccggctgtctgtttccctctgggtctactgttgtaacaaaagacaccgcagcatcctcataatcttcactgctttcgatcgctgcctccatctttctgggtatttcctgctgttcttctatccaggcatccacttcttctttgtttcggcagaactttgtatttccagagtaagaaaagccttcctccgtccgggtcagttcgtgtacactgaatggataatcaaaccgtcccgtatcaacgatctcgtatcttctatcctgtaagactcccggttcttttttttctaggaattcctccgcctgtttttcttcttccggtgaaagtcccagatgttcttcaagatatggaataaatacttttttatcccttgtaagctgtgctatcgtttcctcaagcataccatcttctgcccaatgctttctgtacaggcagtctggggaaaggcagtacgcatagtattcccggatatgttccaaaagtgactttccttcacttccaatatcatatctcccccggaaagaatactcctccccgtcaatgactgcgtatacggaaaaggctgttttataataagaaggggcttcttcctcttcctgctgttttctttcctgttcatctaatacagtaaaaactctgtcggctacagcaaaagatatttttttcgtatgaaacctttcattttctttgtcataaacgcttaacctatcatgttctgaataatcgatctggaactgcagggtatcctcttttttctcctccgtactgaaattcagtacattttctttttcctttgtgtgatcctccttaaccgattgttcctgcatttccttatccttaacataaggatattctttgttttctatcaggatacggatacgtttttctgcttctttccatgtcagtttcttttctgcctttcctttttttaaatgaaatcctttggcatcatgccactcatcagaatgggaacttcctgatatagaatgggaatgtcctccgataccatactcttcttttaggaaagcgatcgctacttttttgtctggcataggttcctgctgataaaaagacagtatccggctctttcctccttgaacgataccgccttcctgcaacaatttatctatctcatctgctgtgataaatgctatgtgtactggttctgttccattttgtgaaacaggtatagatgcctgattcagttttttaagatgttcttttgctgcttcaaaattccttttctgccatccagtttcaaaatctacacgtttttcaaatgatagaagttcttcatatatggtatttacacctataggatctcttagctccccagtaatcttctcaacagcttcaatataaactgaaccccatcgtgattccagcctgctgtctctgtaaaagaaaaaaacatattctgctattctcgtccgtatcgtatcaaattctttttcctgcaattcttttgtagtaaattgtccattttgataaagactttcgatccgttctgcggcttcgtcccacgataatgtcttttctggattccttcttgcaccattcccccggcgaaaaaagatcccttcctcactgtaccatacactgacttttactccgtctggcataaaaagaccctttccgcctttccatgcctctttcaggtcttttctaagcagttctcctggttttttctgcatcaggtcaagtagcacatattctaaagaatggtcatcattcccgcctgtccgtaaagcttcgtcgatataagtttccgggaacgcaaaaacagcagccggtttatcacctgctgctgttccataatcagcttgttcttgttcattttgtggaaataagcttaattgaatataatctcctgtttcactatttcctccgcctgctgtttgcagttgtttaccagtccgacccatttcatctggtcggctgctttcagttcctccgttacccctgccgccttcatcagctctggcaccagttcgtccatcctctcttctgcctgcttctggatctcgatcagatgtccctcgtaatctttcatcagaaggatctgatatgtcgatctgtcgtgttctttcaggtatctttccctcatcagtccgtatttcccgatgtgcccctccgtctttgttagtcccagctctggatacatcagaccgtcttcgcctttcgtataggttaatttcatcttgttccgcctccttttgtactggtatctgtctatcttgattatattcttttgcccttccttctacaatagtttctgcccggtttttttgtaaatttttctgaaagagataaagtccgatctctttcaggactgatgcacaatgctcgcttatcggagatcccaatcgcagcagcacatcctcattattaaaatctgtgattgaccgaaaatcctccagatacatatattcctcaggatctatcccacaacggcttaacagcagataccatgccgtagataagaacagttccctgtactctagccgtatcgtatcttggtctaaatcctctaaataagaatcctgcctgtccctcagcagttttggcacttcttctgccatcgtgtcttctatgatctcttctgttaacttttttaacatggtagcaaggtctgcctcttgtcctttgatatggtatctcctttgcagatgatcggacacatcttttttatcctcttcgtctatctgccagaggtatggcttccttacttctgtaacagggactcccctcacaatatcggtatctttataatcatacacataccttagttttttccgtccatttaccgtatgtatcagtgcgatccctgctgttccctgctttacataatggtttgtttttttccatatctggaaactcgtgcatcctaccgcattcggacgctgtgcgtagatcataagctgatcatcaaaactatactgatagacacgggacgctgtgtttaaaaaacgcagccattcatcaggtgatgaagatacttttctaattgtttcttcaagcatttcctcggctgttagtaatgttgttgccatctgtaatttctcccttcttttattttataaatctttattttttcaagtaagttttcttatggaggtccacgcatcataatattcacccttctttctatatcaaaattggtaattatggaaattaaaatggcaggtatatacaaattttatgttgcaacatctactaacccatccattttgtaccgaatttcagtacaaaaaaagcagaaaggatacgcctttctgcttttctacatctaacatactttaaattttaatgctttattactatattttctattaaccatccttcataatgctctgatgcattatacataatctccatatttttaagtgcatctttccgcaatcaattgacataatgcagctctctgatattctcttgtaagttcctttactttattatgccatttttttataaatggactatatgtaaatacaattgcacctaccaacatcactactggaacataataattacttgcaagttttaaagcacatattattggcaaaaaatgaacagactggataaaatcgtatttaaaaatttttcgtttgtaattatcaatatctgcgtcttcccacatttttgtacccattagctcgtttttccaaaacttcccgtctagatctggcatttgcggacaataaatttggaaaattgcctcaatctcaggtgtatactctatgacatgatacactttttcgaatttactatctgactcgggtttatttgaaaagtacaataatttttcatttctatcatctgcattttcattttttttataacaaattccacaataagggaattcattccatttatgttttttacaaaaaataactcttcgaaatgtaatgctctcatctgatagaatataatcatcatcccaaaccagaaaaatcagaaggatactgaatactacatttagtgcaaattcgctccaacatataccagttctcgaaaaattttctgctactgtttcccttgtaagtccatactgacaagcaaacataaatactgtaaataacattactgccccttgaatttttctagaatatattacttgaaactccatttcatcctcacttaatatatacactcttaaatcaaagattcaattcaaatacatgtcaatatcaataactgcatccaaataatttacaatatttaaaaatcttttctcaaaataaattgccggcaagttatctttctcaaaaattggaactatctcaaaacaaacttctccattattttctttacatatctctttaattatttccaattttccttccaacttccttaacaaatcatccattaccggttttatatctaattcttcaaatgtgtctgtaaccaatgaccagtatccctctaaatgctcatttttattaaatggtgacattctagtttcattttttcttttacaatctgaaggttttatatttaatatcctttcaattttatatacatcaaaattattatcaaaaaatatattcatttctatatatatgcccattttttacgataatcctttctttatacacgatatattacttaatataatacaaaaaacattctgtttctttcttaatatacataatataatttaatactgtaatattataaaagtagactggataataatttcagcaaaatatacttcaataaaaatccaactcactttttcctattattttgttctataaattgtcttatctattattgtacctgccttatttattatatatataattcccgtattcttatcaacagctaaatcatatcttgctatagctgcttttttgcctaaatattctctctttatagcgtgagcgtctaatttcaatgtttttttgatatatttatcacttaatttaaccagactacaatttttattatgcactaaaaaattgttttttccaacataatatgtatgaaaatctctcacttcaaaattatataccttaaccggtttttctagctttctatactgtactttttcaaccagtattttctttccgtcaaaagtatgtaaaacatctccgttttttaccttaacagcagctacccaacctcttccatcaatatatataggatgatacggagtcgttataatttcttctccttttaattttaaacagacgacttcttgtgtctgattttcataaatttgaataatttcctttaactcttgttcccctgtatttatatcttctgcatagacataatctccctctcttaatttttctattggaactagaccttcttccgttaatattaatgtacccgaaacaaaacataatgctttccctgcagctgctccataacttatatttttcttaatgagttgaataccatatttagaaagttgtgccacataaggacctaaaaatgctcctaatacgacacctccaacagcagatgcagctatcaatgctgtcttttttgtgccatgtaatttaagtttttttgccaaaaactttcctaatgctacacctgataaacctcctattgctcccccaacaatatgtgcaactgcatatccatctttatcaatataaattataggattattttcgcaatatgcgaataaattataggataattctgttttattttctcctagataatctacgctgtcggcattgatgaatctctttactcctggatcataatatctgctacgaagataatacattccaagttctgaatcgtaataatatcctcggtataataatggatttactgcaccaatcccactgtctgtaccagtgcttgcaatcacatttccccatgcatcataagtatattctgcttttgtcgttccattttcatcaacaatccggataacgtcaccttgctgatttaaaacataataatatgtagtattattatacttcactgcataaggtttgtcattattatcataagaaaatgtcagggtattatttccccatttttcctgatagatcagtccatccagcgtaacatattcatgctttacaccatttatagttttactgtctctaataccgtctacatcatatgtaaatgttatattttttccatcagcagatgccgaagaaagttctcttcccttctcccatgtgaatttccatgctgttccattattataagccaatggattacctgcaccatcataagttatttcttttccatcataggcagtgagcagatcgttccatgaagcatctccatatgtatatttttttgtagcagtagcagttgttcctgttagagtgtaggtctttgcatcttgaatatttccaacagtgtcataggtatattcatagcgtttattctgctgtggaagtttctccatcagaagctgaccttgtgcatcataagaatattgagccagtatatttccttttgtatcacttacttttactattcttccaagagtatcatattcatattttaaagaaaagtcgctaaaactattatttatctttccataggaaatctgctgaatacgtcccgttgcattatcctttgcattgtctgtatcaatgctctcataagaataatccaatttatatacattatttttctcagaaagtttctgtcctaaactatcataaataaaagactgtttatttcccagtatatttttttctgtcaaaacattagaagtctgactgtcttttgtaatagaggtatcgtagctttttccatcgaaagatattttattacctgatgtcaatccatctgtactttcccagctttgtgaataaatctctgtaactccggctttcttttttacatactctatggcatccctatttttgtcatatttgtaagtatatgtataatcatttggtacatcggtaacagtttctatatttccatctgtcgtatatgtatatttgtaggttacggttccatcatatgaaatacttgccaattgccctaatgtatcatatttataagtttctttaactccatttccatatgttaattgagtaagagaaccattttttccggcatattcatatcccgccaacttatactttccagcagatatagaagttacttgcttccatttgttataaccaaatgaatattcctgctgtattgctttatcttctctgtaaccagaccgttttaatgaagacatgattccattggaatatgtatagtttaaagatactaattcttccccatttttatctttcaatgctgcttttgaaagttgcgaattaccggaattgtaagtataactggtggtatttttattactgtctactgtagttttcagtaaatccgttttatcgtcgtactggtacgaagtaactgctccggcagcatccgtttctgaagatatgtaatttccgtctgctgtatattttattgacgaggtagattttgtaccatcttttccttcgattatattcttctgctctgttccttcatcatcttctttcacagaaaattcatttgcagaaataccctcaagattcccagactcatcatatttaaaatttgttttatttccatcttcatctgtcacagaaatgatatttcccttatcatcataatcataaacaaatttaccatctccatcaatggcagagattaaatttcctttactatcataatcatataagcttgcttcttcttctacgagagaaatcccatcaaaatatgctgtattcgcattaaatgtataatcacaacctacaatgatagcactcaacactttacctgtctgtgttggtgttacaactccacttatatattgccatgtagacacatctgcattaaatggaatatattctgtttcataacttccatctgcatacaaaaattttgcatgtaaaccaaaaaatctattttcgccatctgaattgtcctcagcaatatctggaacagattctgcttttgcccaaccagaaagcatataagattgttgttttattttatgatttattctgaccgtctggctgatatttcggttttcctgtaattttcctgtgatttttaatgcattagaagcatataacttttcttcttgtgcaaaagaagtcccttctgtgttcatatcccaacgggcttgtgtaactccggctccattatttaataggttatatccgctggcactatttaccttttccatttgcaggtcatccacatatgctacaccttgtgcattcttcagattgacaaatccatatacttttctactggaagtaaattttttagtaacagagattcgagtccatccattatctgtatcttctaaagtctgataatctaaagaatctccctgtgctaaaactttgcttcctgtatgaaattgtaaaaatacacctccatcttttccaaatttctttacatctgttgttttgacataagcggagaatgtataagtacctggtgataaagttcttccggctgcgtatgctcttacataagaattatctgtactttctcccgaaagcgcaatacttctgtctccattatgtgcttgtttatttgtggctgaaacagaaccatttgtagtagatccacttacattccagctattaatatctattgaagtagccccagcaacttcaatacctccatttacgatctcgctgtatgcttgtttgcctgacgttgcacttgctgtaaggctgttttttgccgatttactcttatatgcccctgtatctactcctaaaacatttccttgaacatcttttgtacatacatttacagtatgtcccgaataatcaaaagtatatgtactgatttggtcatcgctcgtatcaaagttattatcatttcctgcactggtatatactgtatgctgcagatcatgaccgtctacttttacatctgaaccatattccttcgtttctcctgaattattaaattctcgtatcctgtttacaatgattctacatcctaatttttcccaaccatattctactccatatttactttcattatctaaagctgataacagataatgtttattatcatatgtataagataccgtagtattatctgggtgcgttatttttactaattctccaccatcgtaatgatattttgtaatacgcccagccttgtctgtaattttagtgagatacccattctcatcatacgataatgataccaattttcttgctttattatctactttattaatctgtattatagaagttaattgatgacttttttgagttggcttccacaaattatctgagccatattcttttccgccataagcaaaacaaatcttattttctttgctatcttttatagatgtcagatatccttcattaaaagttgttgtactatccccatctgtcatggtataaacagagccattttttgtaacagataatcctagattatcttcatccacaaatgttcctgccttttccgcatcttcatagaaataatgttccgttccatctccatctgtataaatgtaatatatcgtagaaccaattttcttctctactatagtctgttgtgcatttaatttccatccatttcctattttcatagaagaataatcttttgtatatgcactaacttcaccgaaatttccaccagccaatccagaattataatagtgttctaatgaaaaagaaatcgcctcactgctattactataatccatcttttctaacgtaagctgagaagaataatctccgacatatgctgttcctgcactatctatctcctgtgactgagaagaataatattcttctactccataggaatctctgtaatttataacaacatatggcttatttgttgaacgtgttgctttataaaaccgtactaatgcactatatttaacagatgaaatgctttcttcatcatctggaactaaagcaacggctgcaaatttttcatcatttccttcctcatatttcttttttataacagaggttaaatcccaacctacatatttgcctgttgtttcttcagatattttttgagaatctaaaaccgtatttttatacgttggctgactatcccaagtaacaccatttgtccagtctaagcctgcagttacttcttttgcatccagataaaagaatggtgttcttgtatccgaatatggatcatacatttgttgataataatataactttgcaccagtgatcacacttcctgctggaatctgtggtaatttcctaaattctgtgaacattctatgtgtctgtgcatctgctgaagccccatgtcctatatatgctatggtatttccatatggataatatgtactggaatcgccctctacaacataaacatctcttatcacaaaatcattagaatctgccgttgacttttctagtgtcggatcaattgtcaccggatagcttctatccggatcattcatccactcttcatctggtactatctttaatatatactgtccctcttgtgtttcttcaagtgacatttttacattttctgaatagttatcagctgaatctgtcatatatgctgcaggaatcacataaatattttttcctgttttgctatcattaagataaatcgcaccttcttttccctgtttagggacaagattacctaacgatagtaaaaatctatattcatacgtttcggaaggttcttccacgataatatcttcttttaaggaacttcctataagagaataatttaaagaaacattttcttgaattccttcatatgataattgtgtatatacattttctacagcataagaatcttcttgttcctcttcatcaacttcttcttgaatagttcttgacttctttgcattagatattccttctattgtccccttttttattatggccgggacctgttctattccttcataattttctgagaaattttctgattcttctgatttgatttctgatttttcttctgctgtagctgtaattaaagatttttctacattagcctctttttcatttttttcttcttttttatctgattttgaatttattgtttgaaaatctatgaaatcatcttcctcattctctgtttctgatatattttgagattctatatcttgtaacgctgcctgttcatcttctatatcttctaaattctgtttgtctaatatttctttggattcatcttctgtagaaacttcttcctggtattctgttgtggcttcttccacttcttctgtagttacttcttggggcttatcttctgtatttttttctgtattagactcttccatttctgtactagactcttctgcttctgtagcctgtatctcttctgtatcttctaattcctctgtagattcatcatctggtacattttcctcctcatcaaatacattttcttcatcttcactagaaatcattgtaaaatcaacagagtatttatctttttccaaatgcacaagcttatcttctcctgctatttcagaaaatttgatttttgtttctccctgttttgttttatatcctgaaaaatctccttcctcacctgtatctttactatacaaaaagttgttatttatttctttccattttccctgcttatctttataattaacatccattccataagaaactgctgagatacttccatcactcataagaaacttttttactcttgtagaacgttcgtcttctagttcctgaagaatctcaggtgtatcattttcttcattctctatttcatttaaattattgttttcttttggaattttagatactttttcctcaccagtttttatttttacaggtttatcctgactactgactgctttatcaatgccttttaaagtattcgcatatgcttcagaaggaattaattcaattgccagacataaacataaaattaaacataatactctagataatagttttctttttttcattagctttcctcttatatttctttatttttttccaacaacacttggagttgtgccagtggctttatcatttcctgctgtaactgtgtatttcatacggtatgtagcaccagttgtactgttataaactgccttagaatttaccactttagtattgctatatgatttattccagctttttaccgtattccaagaacttccatttttcttttgaagactcattttgacgcttattgagattgatgttttcatcaatacatcaacactacaatttatttttcccgatactgcttggatattaccacttatttggctgatatttccataccgtggcataatctgttctactgctacattagtatgtacatttttttctgctgctattaccgaaaacggtatactaactaatgaaacagtacatatcaacaacaccataatcttttttctcataaaaaatcctcctttaattgtgtctatataagacacaatcgaaggaggataagtgtgacattttattttatattttttaatatttttattaattctaattctttttctgtgctggacagcgtaataatgcatccattgtcttcataatagaacgatgtaatctctttatctttaacaacataaatctcttttccatttacttgaatttttctactcccagttccatcataagtaacatgaacatcaacattttcctttaatccctgtgtaaaaccgatataattatcgttttgaccttcataataagcactatacgtcgttataggattttctgtttcatacagtaaattgtaacctgctggtatataagtcagatgtagctgtcgaaatattttttcggattctgtttgttcttcagaattatgtatgtaaatactatcctcaaagaaatgaatgataagtgttccaactttttctcttaaatcatcatttgccaaaacaatacctgcattcaatatcaaaataactgctgctaccagtaaaaaacgtaatcttctttttttctttgcctttcttttttcttcataaatcattttattcattttttggataaattctttagaaaatttataagaataatttttcgtcttttctgttacttcttcatagtcttgcagtgccgctctctgagcttcctgttctaatagtttttcaaaattcataggtgtatccttttttcaacatacctttctttaactgttctttcgcacgactggatatttttcttacatttgcagaatttgtttccaaaatctctgcaatctgacagctatttaatttattgtgatattgaagataaataacttctttataaggatatttcagtcctctgattaatgaatttaagaattcttctgattctttcttaattaactgactttctagcagattatgcccttctacagactgttcaaaaattgtatcatctgcaattaattcaattttcttacttctctttataaaattgtaacatttattctttaatatagtaacaatataattccatgttccagtgaaatcttcttcatcaattctatccagataatccgttaaagtaagaaaagtatcatgaaccatatcttctgcatttaatttatcctttaaaataacacttgctgtataatgcattctatctttgtaagcatcgtaaattttaacaaattttattttctcctcctctgtatccaataccattaaataaataaacatattcataatctcctaattattttttattattttatcataaatatgattttttattatgttttttattaaaaatgataatttttttgttttttcttcggttttattaaagaaaggttctcttttttctcaaaatgtttttctaaatatcttactgctttcctgacctgtctgttttctttataaaacggtactgcatctaacatctccttacagatgtgccctccggcgagcaggtcacatttatcagaatacatatgcccttctggaaaatgcaggttgataccgatcgcttttataccgttttttctgtctcctggtattttttcataaacagcgatcgcttcatcaatggttagaccctcatgatattcacccaatgatggaaattctgaacattctgtaacataaaaatcaacttctggtattggttcaggttccttatcaaaaatagataatctctcaagcttttccatttggatcagcaggtcttttgcctgttttatatcctcctgatctcctgatatttctatagtttttttaagataatcattcagatagcccgtttttttctgcaggatgtcatctgtgatcgcatccactgctttctcctgctccatcgtttcatctacataccaatctccccgtaaacgtccgaaagtatctatctgttctgcaaactgttcaatttccttttcatccagataatactctgccctttccagatattcaggcaaagttcccgatttcgtttttgatataggattaatgtctatcggaatctctttaacatataacatatcttctttcagatagttaaaaaaactatcttcgctgattggtccctgataactaagggcaacatccacatctgaatccgggcggtataagccttctctgcttcgtgaaccatacaccctcgcaccgatcagctctacttcattatgcagacccagttcatctactatgatctgtgcctgagataagacggtctcttcaatatccgctcggctccttccttccaacgatttttctttgtaatatacttcggaagtaagccgaatatcccctccttttaattgtctctttgactcctgtactgcataatgtaataattctttctcttcactttcttcgatattctgttccagttgctcataaccgatttcttctatagttgcaatagctatcccagcatcatttaaaatatcttctatagcctcggctaatgacacatctggattatcataaactcctccatctaattcccgataatcctcattataaaacgtataatcatatcctccatccgtttcatggatcataaaatatccgctgtctcctgatatgacataggctgcttcttttttttcatgaagcgatctgtttagtaaatattctccaatcaatttcattgcttcaggactaaagccatgccatagatcttctgcaataacctgtccttgttcatttacgataatatctgcaaccttttctccaaattcatcatgccgcatctgaaaaaatttttcattgtgaaattcttgcatttgtatcgaatgccatgtcccgaagtgtccctcggctgtaaatccctgtgttgcttcagttatctgccctactactcttagtgccggctctttataaaaatctgataatgggacaaatcctatcatatctacataagaaacatttatttttccatttttctttaaaacaataatatcgctgatggaaagggaatgtcctgtgaaatcctgtgggtgtgcgatattaaattttacatataggctgtccatgttttcatctggctctaagatcccactataaacaagctggtaatctttcctttgcggcagctttccctttgccctgatggaatcataggaaaggaaggcatactcccttccttctcccttccagtcgatctgatagatcccataagcatcccctttcccatgcaggatctcttcttcacttaagttaatgcctgtctgttctttttttctcatggtcgttctctccttttcttccttacctgacgtaatcgctgcatcattgctggagtaaggctggcagatgcataggttttcatctcctgtacactatctccctcttccagacattggatcaggaattctttttgtgcatcattaaaagtatcttctgccagataagtctctataaattcattattgttatcttgggtccctctcttcttgttttctttacagaaaaaatgccagcgtttcttttttctctctctattgtttaccgtatcttcctctataaaggcggcttcttttttctcctcttctttaaccgcagttttcttctcctctaatttcaaaagaagatcttttttctcattctcccatactgccttgttttgttctatctcacttaacaggctctgtatcttatcttcccggtcttttagcagctctgctttggaagctaaggtactctgatatgattctttttgctgcacaagagcttcttcctgaatctttaatgtctgctttaatgttgtatttattgtatcccttaattcttctgtttccttaaatactctgcccgctttttcatgtaacttagagatctgctgtgtcacctgtgcatctggcacaaataatctttcaagataacccgtccgttcttctctgatacgtttgatcttatctttccagttctgtacagggacactgtctattctccgcacttcttctatcggcattccgtctaaaaaacagaagcagtaatattcacaaaacacttcatcttctatttcatctaagaaagctatcacctccgcactgcatccggcttcctgcagtatctttttttgaaattctataacaatatgtttttcttcttttgatcccatttattttttcacctcctgtgctgaatttcagtacgtccttttttctttgtaatcttttcttctttattcaggcttttttcttcttcgatcatccggtttacaatccgtttctcatgccgcacttcacgcagcatcgcattgatctgcctttttttcttctctgcactgagcatcccttccggcatctcttttaaaaaatcatttagttcttcctgatatatttcaaatcggtcatcccaatcgggagtatcggctaatcgtttttttaatacttggtactgctggaatatttttttatcttcgacggaaaaaagagtctttcgctgatcgaaaagctctgcttctttctttatcaatatcttttgtttttccagcagatctttttctgttttaatctcatgctctaagatatatttacactcttcatagagttgatcaatatggaccgcatttctcctcacttctttccatgctactgcataaggatttttttcttcaagataatgtcctgtctgataaaagtttttaatttttttcatctgaaatactgtgagcgttgttttggtatactggaagatctctctttcataaacttttgacagttcatgggacaggatcttttctaccccctgttcctgtcctttattttttatcctttccttgatctcctctgcccggtatcctggcccaagccgggaatctctccttccccgttcaaaaccaggcgggatatatgtcacatattttttctgacggatcttatagccaagcccttccatttgccttatgaaatcatcccaatcttttgatgaagcaatcacaaaatctatgtctgccttgataattttttcggatgatggcctgccttctttctccgcataatgtgcggcataagattttcctatcttattgttcttgtcataaaccaaaggcggcagaccgtatttttcacagatgcggtctgtgagaggctgaatatatttttcccagtctttcttttcataacggtatttatatccactcatccggttcacagaattaaagacaatatggccgtgcatatgtttctgatccgtatggatagaaaaaacatagtcataatcttctcccagatattcttcacaaaaatcatttatcaccgcataggcttcttcttttgtagcttcccctggcggaaaagagatcacaaaatggtatccctgtcttcctccttccttttcccattcctgttttgtatcgatcattacctgatacacttcctgcggagtcgtccccgcatttcccccgaccatcccttctgttttatctgggttcatgatgtaagaaatacaattttttaaatgtgcagccccgcctccctttggcattccaatatttgatagcttagtgattgccataatcttctaccttctcattaagcgttttcatctcatgctttacctgctctaatgctttttcaagattataaatatcaatctgattgccataaccagcattaatttttgcaacgacctgattgatattgactcctattttacgcacttggtaggaaagattctttaactctttttccaatcggacaggacgatcttcctgcaaaaaaatacacttccgtatatatgcagaagtgtttgctttgtctccctttttagtttttgtctcaaggtcgtttccagccttagatagaagtaactgatattctttttcgctcagccggatgtcgattcttctttttcttatctttcctcaccttcctgtctttctttttgggtcactctttcctcctcctgatcggacatatacatatccagaacaacttttagatcttctatttttttaggatccattggcccaagatattccgtaacaatatctgcaagctgtttattttcttcattttctttttgttctctgacttttctcagtttttctcccacttctttttttctttctgcaatcctgttttctttttccgttaatttttgaagttcgtcctccaatttttcaatctgtttcttccaatccatctcatcaatctccttctttattttcattctcaaggtcatatattttgagttgtaaattttctatctctgcctgcagtgctttcctttttaataattcatactgcgataccactgcgatctcatttggatattcataacggcagagtgtatatttttcttcttcatcatctcctcttggtcttggatatttttgatacatcttataccattcttcaagaaaatcattgatgatactatcgctgtcaaatcttaaatagtatccgtcctctttcttaaccgggtgcaatccatgaaaatcttccatatcaaataatgcgtaaaacatttcctgataggaaagcatatccgcatgaaccaaagcaccttcaccaactcctaaagcattacacatagccttcaagattttttctcttgggatttttttatttttttcatactgtgcaatccttacatctgcggaagaaagagaaaaaccgcacatcacacctaattctttttgtgtatacctacgcagcattcggatttttttaatcttttgccccagagaaccgggtgactcccaatttccttttttatattccatgatttgctttatccaatccatcctatccatcccttagaatctatgttagtatttcaggaaatctggttttccataaagttcttttttctctgcatcacttgaaaaagaactatattttttacctgcatcttcctcaagctttttttcgattcgatccagtttatcctgtatatcctctaatttatccatcacattttctgtttcttcttttttaaaaaaattccgtacagcttctgtgatatatacattttctgtaggatacatttctttatctctgtgatttatcctctccagaacatcgtctggaagacggaaatgtttctgccttgccatttattcctccataattttttatgttatctataagcgatcttatgatttatatgtaccattttgggtattatccatataccaattctggtattcataccaaaaatggtacgaataagccgataggcttattgcaagatacgcattttgtgtgtacaaaatactaccttgttaggggaaagcccctaatacccctttcagacaatcactcccaattaacacacatatgacaggactgcaaataaaactttatttcctttttgcagacctgccatatcttatcacccagtatctcttttttaatcacacttatttaaacgcaaatgtataaattccattttcaaaagtaatactgatattttttccatcgcttctttttgtactgaaatccagtacagctttataatctttttctcctgtactttcaacggataccgcataaaaatttctccgttcttcaccttccttctccaaaaattttagtaattcctgtgacaattctttttcatcggctaccgcacctaatgaatcatcctgatctacgatattgggttctccaagattgattggttcaatcccaatttcgttatactcttcttcatcatcttgcatcgtatttttttcctgtgacattcctccatagatttcaatgtttttgatctgttttttatatggagaaaatgaaaatatctttttctttttgtcatacgagacaaggacgatagaatggtcttcatcatctaactggagataaaatgtcgctgtccctgtattgcttgatacatcatcatcaaactttgcaagggcattgattcattgcacgtttttataatttttttcaacatactctgctgcctgttcttcaaaatctgtttcattctcagaatttatataatagatatattccagatttgtgaaatgatattgttcccttttttctttttccgtctgttctgcagcatcttctgtcttttgttcttccgttgtattttccctgctgttttgatttttttggggagcgaaaaaacataaagcggaaacaagtaaagcaaaaaccagaaagacagccagtagaaatatcactatttttttcttcatcctgctcctttcctgtaccgaatttcggcacattttaattattatttcaaatgattttttccaagattaattgctttaacaacccggctttttgcccattctggatgaaatttcgtgacggtttttcctgtgtgataccacatagatttatttacaacaaactcaacaacactgtgtccattatcatgtccccatttgttgcagcctgcatcagacatatttttttcatcgcccataacaccatgtatgactctgccatttgccagaacaaaatctatctcatctccgatttttccgaaggttggagtgcaggctatcacatatctgtcccctatctttccgaaaccgttcgcatcgtaatgctcacctgttttcacacgcaacttgtactggttactgcctgttgcggtgatgagggaccagcccatgtaagtgaaactgtctccatacggtgatgggatattgattgtttttcctgaaccatatccgtcttggtcttttacccggaggatcactgtgatgaccgcccagttaatttctcctttacggacagattttacaaaaacacttcccggctttttgtcttttgtctggtcacgtccaaaatcataccagtatgttttaccgttctcatcttttccggcatagatgttcgtatgccctttgaaaaggcaaatatcccccggctttaagtcgaggtcttttgattttttcccgccagtctttatgatgtcaaatcctttttcaatctgtttccttacggttccattgcagcttaactctccagacttgtttccgaaaaatatctgtccttttttcagcagaccaatttcctgaagcacaagacagacaccgtgggcacagtttgtcctcttagcagactgttctgctgccgcaagtgaacctttcaggtcagtattggaatacacccatttttcctccaccatcattttaccaagctcctgtgcttttgataagatctctgatgctgtcgaggaagtgagtccttcgtctggataatccggagtaccgtatcccatgatgcctttataagtaagctcataatgtccacgcatgacctgactatttttgttgccctctattgtatgtacgattccattttcgacatattcaacgataccaacgtgatgggattctcccaccccgcctttatcaaaatagataatatctcctgcctgtggggtataacttccagcctttttatactgctgcttatggataaaccattgccgtcctgtctcacaggcggctgtctttggtatgatattgctctcgataaaaccacattcatttgcacaccacgaaacaaacgcatggcaccaggacattccgtccgtgcctgtatacactccatactttgtatggttgcctgacccttcgtgataacctatttcctgtacagcaaccgcaacaatacttgccccggaacccgatgcataatctgtattatctactgcggctgcaaaacctgatagcaacgtgatgatgattccaaggaaagatacgatcacaatgatcggtattaacaggatcaacaaaacaaaaaagatcgtcacggcaatctgtaccgcaaaatacatcactgtaactacaacagaggcaagcatagctgcggctgccacgccagggcttcctgcacctgttttattttcttcgatgagctgggacaacttcgtctgcgtctttatcctctggctttcgattgctgtatttttctgctgcagcatttctttgaaattttctgccgttttttttgcgaccagtgcagccagcccagcacccgtagatgcggctgcggtatctgctgtttttgctgcagcacttcctgtagcttttgttgtttctgctgaagcagaagacgcaatatctgctgtcttttctcctccggcaaccgtactctgggaacggatagccgcccggctgtctcccgacttagatgcgatctctccatttccgtcatggctgccgatctcttttttatccacaggttctttccaagtattggatttatattttctttcctttaaaaagatctctgccgcctgctgttctttttcctgaacggaactctgttctgtttttgcaatcccgttcctttttttctgccgttttaactgccgttctgcctgcctgatataacgctgctttgcagtataagacagccttttccattcctttttttctttcttagacagataatttgctgggtctacactcgcatttccctcttcctgttcctgttcttcttttgcattaagcgggtctgcatttttaaccttttgtatagcacttttggaagaagcataagcactatccattcttttgaaactggcatccttcgctttttttactgccatgatgatcagcctgctttctgataacggatattaccggcttcttctgtttttacaagataaccttgctgacacagccagtttaattgtttttcagcttcttcctgtgtgatctctaatacagataagaggtcacggacggtaaccggggcaagttccgccatctgcaggatgatctcctcaatacggtcattgctttcctgctgttcctgtctctgcctttgttttcttttctctgcttcttttgctttctcatgaaagtttgtgttgataagaggatacagttcattttcttttgagatcttcgcatcgaaaaggacaacctttttcccccataccatgactcctcttcctacttcttcagaacttaatgcattaaattctgtctgggataattcctggatctgggcaagggcattcgcatcggctcctccctggtctaaaaagcatttatagttacagttactgaacaattcttttaacatcttgttttctaaggcagcagtgatattctgcattgccatcgtacagataccgccatactttctaaatgtggcaacagccgtattgagctgttctgcagaagtaccttttcggctgacaacctgcgtttcgtccacgataaagtgggttgccctctgtgcctcttgattgtattccattcgtgtagaggtataatgcataaccgttaccataactggctcccagttatccggcggtacgttttttaatccgaatccaatcatacggttatctaaacgtactgtggatggataagcgagcatatcacaacttccgtccgtgtattcttcaagagagttatagattggctttatgatagatctatcataatcatcttttgcattttccaattccagttttatctcttccctcaacatccgtaaggttgcctgcttctttaattttttctgtgcaaagattttatcaaacatctttcttgtcgccctgctgactaccgtagcgtgttcctgcgtgaacaggatatttgtcatgatggccgcaacaagacttttggcgtactttgtctgtgtagcgataaatttttctttcgtgtctttgtccgcataaaatactgcatcagatacttcaaaaccattgatatatatctttgattttggagtcagatcaaaataggaaccgccgtatttttctacaatttccttaaattcattctgagggtctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctaggattaaaatgtcatctgatgtagagataagtgtctgaaatatctctgtcgccttaatcaacacggatttacctgaacctgtatgcccgacaatgattgcgtggggattcatcagtaattttctattgccaaatatcagacgttttgttgtcaggtttaatccataaaaatacccgccggggtctaagatgtcctgggcaaagtatggctgcatcgcaaccatcgaggaagataggaagaaacgcatataatcgacctgccgtccggcaaacggcagtgccgtatttaatgcttttaactgtgtgtaatccgccgtactgatgactacaccctgtgcctttcctgtttcttttaactgctctacccgttgtgctaatgtagattcatctggtgcagttgctacgaataaaaagttcaggaaaaatcctgtctcatcgttatcgttcactaaatccatgtatccttcaatctcatctttctttctctgttttgcataagatggtccagatacgatgatatttttctttctttttgcttcttcttcctcgctgatggatttctcattgttcattgccgcagcgatcagtttttcattgataacatctgccggtactggcgaaaaatccagcgtaataaaagatggaaaatcaacataagagaagctacgcatcagttcatcaggtttcagtgtcctgctgtatttccagccgaacagtacggaaacatactgcgttttatcaaatatcatgaaattggaatactgcctgatcgtctgcggcatgacatcattcttccagtcatgctttccactctcatccagatagatatactgttcttcctcctttttgcctggacggagtaatgagtgcagacatttcagacgttcttcgccatttaaaaggattatctttcctctccatttggcgaacatctgctggattgtagtatccagagcatttagtaaaatggtcgcttcatctaacgaatttgcccggcacgaaaccgtcagataacgtagcgttgttacattcggattagaattttctaatttttcccttgtccattcctttatccccctgtcaatctgcggatacaccttactgttctgctttccacggattttttttaggaattcatcaatactctgaaactcatttgcaatcgtgatcttaaaatcaacactcattgatttcagccatgacataaactggttcagaaaaatatctttttcgctttcatccttgttaatatagttaatctcctcaaaaacataacatctgtcataaatactgtttgtttttgagggttcaatctttgctatcccgtttttatacatccgttcaatatttaatgcctgccgcacattcttcgggacaggaacgatgggaacactcttagaatgaaaagagcggaactttccactcgcattgataaccgccacgttgattcctcctttaatcgaaaagagccagaaactttattttccggctctgtccttttattatttcttttttctctttttcttttttacagcaggatgacgcatggtaaatatcctgcctgtcttcggagcttcttccgccccataagtaagttttttggttgtcctgtaaaaccgcatctctttccacatttcccataacgaatggttctggtactcgtaaatgccaaaaaaacatatcgggagcatcacaggaatggcgatataactgcctgtgatcggtgagattttcatgaacttccacagtgctgctatcgtgcctgccgccataataattccaatcgcaaatgtgatgatctgctttagtgtaaaacctttccagaggtcgtctggaaaggctttttcaaaatccttgttaatatcaatcttcatttcatatcctcatcatttgtaataaaaagaaattcttctgtttccacatcgtttacatttctgagttttctgatattggaactttttccctcgtttctttcctgtttttatactcatccctttattataagaatgacctaaagccggtaattctttataacttaaatagcttccacagatttcttcgtcaccgtaactcttagggcatccttttcttgtacagacaatctctttatgtcccccagaaagacacgttggatgtaaaatcctcggttttcccggtttatgtcctaacgctggtgttttcattatcgtttggaaccattcttttccgcaggatttacactttttatatgaccttccccggtattcacaggtaggtttggttaacgtttcccagattatttttttatggttacacttttttgcctttgcctgcgtactgctccccggtacaagtaccagcactatgagtaccattaaaaccacagcaatatgtctttttgtcttcataatctttcactcctttttatctgttttcaagatccatcatggaaaataatagctccagcctccatattcattttttaacttaactccgccgcatttcaaacagtcatatcttgttctcttctttctggtaagtttccatttgtgttttgtcttagggatcactttttccagcaacacttttctgcatctcacacaaagttgttttttccttcctgtatgattacagtttgctttttctgcaatgatccacgttctgcctgtatgtttatgattacaccctgcttttgcctgtgcatttgcaaaaaataccatagtcatcattatagccagtaacactatagttacttccttttttaatttttccataaattctccttgtatcaaatagcatgaagtttctctttccagctatttaacataaatcgtctctttctttccacatctgctgcatatacgtgtctttttcggtttcttttttatcatactatcggtatttaacttccacttagtccagtgatgtccaagagctttcccttccttatgagttgacttgtacttacaattcttacatgaagttacaatcgtttttggtgcagtacaggtagccttgtaagttttagcaatataggaatgtcccaaaggagctatcttttctgttttgtaatatttcctatatccataaatacaatctggatttaaacaatacgttgccgttaatcccggttttgtgcatgtaggcattttttctatttgtgtgcgtaagcagtgtcctgatttttttatcttctttatctttaagatttttccacagttcttacactttttaaccttcatgccttcatccgtacagctaggttttgatgttgtgatccatgttacacttttatgattacatttttttgcttttgcctgtgtgctgactcccggtgtaagtatcagcatcacagacaatattagggctattgtgataactctttctattttagctgcaaattttcccatgatctctcctttcccgtaccgaaatccggcacatttataacatttataatcccatcgcctttgacagaaatgcattggaaccttttacggctgcagttacaaggatcatagtaaacaggctgtttaatgcatcccagaacccatctaccatagatgttgcaatgttttttccgtcaaatagcgagatgcctgcaccgatgagcttgaaagatatgaccatcgttaaggcaatcactacaatctcaaatgcatttaacaggaatgtccgcatccatgcatagaaactacgctctatctcctgacctcctacaagtgcagacatcgcaaagggtgctaatatcatgagcagatatagctttatgtaccggctgtatactgtccataacatcaaaaagctgcaaacgatcgctgccagtataaagagcaagccaaatagctgataaaacaatgctgagccaatatccatatcctctacttttaaatccggggcatctatcgtaaagacttctttcgccatcgctgatgagatagaaaatatggttgtcattatatttaagatattgagatacaagacatttgccacgaccaccttgatcattgcttcgatgaccatctccagtgtgatgttctgatgcaggttactcacagctttcaaaaaggctatcataaaaaataaatttagagcagagagtccgatcccctctgcccacggatacaggttttctttgacaaatgcccatgttcctgtagaaaacttttgtggcgtactgcagaccagctttatgatcagcttcatgctggagttccagattgctgccgcaatctttattgtcggaccagagagaaagtcaaacagccattccggcataaatcatccctcctgtccttattttaaagatgcactgataacagtaacgatctgcggggcaaggcaggcaactaatccagatgcgatacgtttaaatgccatcgactgcattgttccatcctgagagtttaaagccgttgcccattcaaacactccccataacagtaataactgtccaatactgctcacaatcgctgctacgatctcatacagcgaattaaatcctgatgtgatcactgaggttcctgctgcttttgccgcatacacaggcacatacatactgaaataacaatatgcagtaaaaaaagccgggacagctctctttactgtcctgactcctttttctctcattgctcctatgaagttttttactctgttcatttgcctagtcctccccgatgtgatttgtaaaaataatgatcaagatgataccgacggatattacgatctctaacagtgtcgctaacagacccgtccaagcctgcattcctgctggtaacagtctgggcaggatagcccttgccgccagatttgccaccagcccaacaataaatgcgatcaggatgataatatatttcttccagttatttcttctcacttatgattcctcctttaaaggcagcaggcgtttctttgctgcttcttttcctataatatctgtaaacagacgctctgtctgttctgtaccatctccggcatatttatataatgccgtttcgtaatccttatacctgctcgtatacaggtaggatattgccgccttaaaccttttcttatttttcctattacggctctttttcaccgccagatgaagcattccctcgattgaatctgctgctttataacaattaaataataagtgtattgtctcctcatcatatactgtcctcggtaatttttttagatatgccggctttgacctgatgataaaaaaccgaatagcaaccacacctattattaatactatcaaaactgcttctgcaataagcatcggtttcggaacattctctactgccagtataaaatttttcattcttcttctcctgtatctgtatcaaaataagtatcaaggagacggtctaaatatcttaaaagttcttcggctgtctggtctttatcaaaatctccttcggctgtaactgtgttatctgatgtatcatatttaaatgtaaggtcattctgactactattccagctacggattaaccggcgtaacttacggttgttatttccaatagatttcttaatatcaaaccagccttcttctgcaaaaacaactgttactacaatctgggaaatagcaatgttgaccatatcaccctgttttgcatggcggagctggataactccgcctacttcctgttcctgcagataattataaaatccttcggctgtcagcggggtatccatctctatcgcttccttcaggttttcttcttcctttgcatacacagattcttcttccgggactacttctacctcttccacttcctctacagcttcttccgcccctgatattctttcttctacaggttcttccgccttaccgggaacatcctctttcttctctggaatgctttcatcctctacccccatcagctttttccaaagctgtgctttttctttattcagggtatcaatctgtgagacaaacccactctctttttcttcccattcgtcagctttatcttcccatttttcaatctcctccttaagtttctggatttcctgtgcttgttcttttatcttctgttctttttcttctaagacaaccgggtcaaagttatcagaagaatatcctaagtcagccagtttatcttccagttcccggctaagcctctgctgctttaatttttcattgcgaatttcttctctaagaatggaagtatcaagtaaggactgctgttcgtctgcttctaactccaacctttttttctgcagatacttttccatttcctgcgtttcccgctgtctttcttcgagcatctgcatcttttcttctatctctttttcctgctgtcttacattttcttcacgattgttaaactgctcctcctgtttctttaagctgttttctttctgttttacagcttcttcacgcatacggtttctttcttccatttttttgtattccgcatcacgctctgcaaaaatcttttccatcttttcaaacaaagggtctgtatttctgtttaataattcactcatcttattatgtaccgaaattcggcacatcctccttccttaaaatttatctctatatttatctggtctggtatatctgcttcttcctactcctaaaagcggcgcaaagataaaaggcaaaaacatgattcctactgtataaccaaatccatgtccaaatgctctgcttaaactataataaagcgttaccgtcaatccaaatgctatgcttggtagtacaaactgcagcgtatctaaaaggacacctgcatttaatgttacagatactacttcgtacaaaaaaaggcagagccatttgaaaagacagatggaaggtttccatgctatcttaaataacagatattcattataaaatgggatcagcactttccatcctttttcaccagctttgcaaaaaattccccaatagccgatgactgttaatatcagtaaacatactgccatcaggaataaaatgatcaggattgcataatcttccatatctcctccatcaaatagggaaagcctgttggctctcccctatttactcttgtttaaaattttcttttaaatgtgccgaaattcggcacgttattttttacttaatagtaattacccatttatggacatcaccttttatccatcctcggagagtttttttcacagtacagctaatagtgaccgttccttttttcttcacagtcaccttatgaaaaccttcttcatctcctttcgtggatactgttgctattttagaattactgcttttccaatcctttgtttcaggatgcattgctgctacacttggaccaacccataatttttcttttttcttcatagtaatataattggttcttgtaaccggctttcttgtagtgcttttctttgccggtttctttttgctcttagcttctacagtaatactgcctgctggattttttaatgatgccgcagatggacttacaagcatcattgcaaacagtaaaaataatatcgccaaattcaaacggagtatcttttccataattcccctcctacaaaaagagagagccggcaggctctccctcattctttgtttacagatttagaatttttctaaagtcattggtttctttttcgcattccgtctctttttaataagaatagctgcggctgctaagagtgcggctgcgatacctgcaaataatcctgcatgtgtgcttaaacctgtcttaacacctttcggtgagctgttgccagatacaccctttcggttgattatcttcttgataactttctcgattggatttttcggtacttttaccttgactactgcctctttttctggtgtctggtctgaaatgatggttgccttgttcggaatcttcttacctactaatttctcactgttgatcacagcatcaaatgtgatcgtagatttttcggaaagttccggatagactactttaaatcctttctttgtgcggataagatagatactgtttgtatccgatgtcattgtatcctgctctggtactgtgtttccatctactttgatcgaatcatagtcaatatctacaccgtcaggaaggtctttatcttctacaacagcatttgtcaatttaccatcctttgttgtctgttctgcaacgatcgtataatggattgtctcccctacatcataaacagcggaatctgccctcttttcgatatagctgtctggcgtacctacctttacggtcttaatatccgtagcccagtttgacagtggatgtttcgttgtatttgtttccttgaaatcctcattccagaggtcatctggaatatttccatcttcgtttaaatctttatcagttgtttctttaatctctgccgtatttaagataacatcttctgatgttgccttttcatccacagtgacagcaaaagaaagcgtctgcgtacttcctgcacgaagggtatcaatgatataagtgatatactgttttccattgatttccataatcttgccatcattagaagctgaaccatctacataattgctaagttctggaatggcatcccttacgagaacattcttcaaggttgtttcagaatcattatgaacgtcaatgtaatagataatctgtccaccctgttttacgactgttccagatgccgggtttgatgttttccttgcagagatattctgtgttacctttgtaactggaacgtcaagttcaatttctgcataagcgttatctgcctttgcctttacaatattagtgatagaatctttattcaggtcagaaagaacctcagcgtcataagtaacttctaacttatcttttactgtaagattttttcctgtctcgattgtaaaggaagtatcatcggattttacagaaaccggtgtaaactcattgccgttgtagtagaccttgatcgtatcgcctttgattctttctttttcggaatcttcatcttttaaggcatccttgatcactacatttactgcagttctgtcctctcttgtctgtgttacagttaagtgatattttgcagtctcacctttctggtaagaatctttatcactttctttttctgttttgatgactggagtttttaaataaacgatttcatcatcttttacttcgtctgtattagaaccttttgcagtcgcaacatttacaaactgatttgtgtcagcaggctctttatttatcttcgcttcataagttaccgtgaattttgtatgggtaatcggtgcatcccactcttcctgagtcaagccttccttattcttccagtgaactttatcatcaatctctgctaatttcttaaatggagattctccatcatagcgtaagttcattcctgttgtaatcttaaaagaagtatcatcctgtgtctcaagataaggtttctcagcatcttttccagcttttttaccaaggtcatatactgcccctgtctcatcctttaatcggatagtgccttcaacgatagtctcacccggagtctgtaactggtcagtgatgacaatatctcttgctaatgtaccttcatgtacatttgtaacaacgagagtatattttactgtttctcctacattgtattccttcttttctacggactttttaatgtttaagtgtggggtatttacccatacacgctctaagtcatctggaggattatccttatcctttaacattaaggtagctgtaacatatgcccggttttcaatcacttccccgttcacacaagtaagtttcttatctgcatttgctttttccagacagtctgcccactggtctgtgatggaatcgtaggtggacttttcttttgccgtacaggtcagtttgattgttgcagcttccccacggtacagtttcgggattgtgataacaaatcctttctctgtgtattctatctttgcatccttactgatgtccctatcctctggtgccccggatttttctttatcaaaggtgctgctgatggtgatagaatctttatccgggagcattgcctttggaagactttcatcggtaacaacaacattatctgcgatactgttactgttagtatcaccgacattgattgtgtaatctactttatctccaacctgccattcatatttactgctttcctttttgattgtagggtcggctgtctctacggctgtctctactttatctgtagtacggtcttttacgccagtctgtccctcatattttatctgggaatcaatatggctctttgcctgatttaagaacgcatagacgtactcattgtccttgctctttaccaggtcagtaaatccagataatttctgcaggtcggataccttctgcagatgtgccattttctttccgccaatctcaaggtgtccaagattttcatcttttaacgtctttgcatcggctgaaatctttacagggaaagaaacgacaatcttattaccagattttccgccatagaactcatcagaagaaagcacatctgattttgctgtgagcgtaaggctgttatcctccccttttgttatgtcaaatttatcggtataatccttgtcccctgctttgattgtaatgtcttttacatcataagaaagacaggaatctactgcatctgtgatagtaaaggatttgtaatggaataactctaccgtatgtgccgggatttcctgtgctaaagtatagagccactgatttgttacatctgtgacacggttatggcttcctggtgttttttctccatcctgttttactgtcgcatcccagttcaggtcatcactatccgatacttttttcactgggtctttgatagatggtacaggagaatccgttgttgtaggtggtggggttaccttcttatcgacatcccatgtaccctgattatcggcttttgttgttgtaactgttgtctcatttttaatcttaatgtctgtctctgtctttttatcgttctccacaaggtgtccatgcgcccggagtgtctcaatcgaaactttctttgcatcaatgtgtgtttttacaaccatctttacggtcgttcctgcattattcccgtaaaaatctttgttatttagtaaatcagaagatgctgcatattctaaataattttccttacttgcagaagttggggtgaaattattcgtgacatctttatctcctgcatagatcttaacagaatcaatcgtcagacaggaatcaatatcatccttgattacaaccttggaatactttgcggtagaaggcatgttcttttcaatttccttagaaacggtatatgtaaatgtctcatccgcatttgtaagagtattgttcaggacattcttctcgtcctcatcggaaacggtcttcttcgggtctggatcaggattgtccggatcaccgatagggacttttgaccaaacggtggaagtgttctgtgaagcagagccataatctccgtctgttatatcgtacatcttatttttactgtcgtatgtcagcttcttcagatatttcatgctccttttagctgcatttggaatcaaacggtatttgttatctgaagtacgctcatgcccaagccagctatatgacgcatctttaatctttactttaaatgtaatagttactttttttccataaaaagctgtattacttaatgcatccgttttggcactaaatttgagatgttgtccactcgaagaatctgtaaacttacttgtaaaatcttgcccacctacatttacttgcaaagaatttgatacatagctaagtccatcatctatagtatcttcccatacataagaggatactgctgtttgactctgatttcttaatttctctaacgtatcagaagcatagtctggaatactatcttcataacggtatgaatatgtatcacctaattcataatttactgcagatgttttttcattactaatccatgaacttccattctgaattaatttttttggtgtatctggattttgattttcttcaaaagaattcattgcccatggggctaaatcaaaataggcaatcgctgtatgacctgtccatccgtatttgatagacatatcggtcatattttttacataaagtgagatacatgttttattaaatgtatcttttcccatatctgaagaagcattctggtctttaattgctttgtatgtccatccgtctggttcacaccatgtatttccatcgctacctccaatataagatgtatttacgatattttccattccatcagtgatggttacatactgattctgatcaatatcctggaatgtagcaaatccagtaaatggagcttttgtattcgtcccattatataaaaacgtatatttaaattttacccatttaaaaccagagaacatgacaactcccgttttcttataagaaaaaccaatagcatatccaagatgtgctgaattgttatcatgcccgaacatatcaccatttgatggtaatggtttggattcgtcgttctgtgttttccaatcggtcacttctatttttaaatcaaccgactttccatttgctgtcgtaacatttttatactttacccaaaaatcagatgggtcatgattttttgcgtaggcggcaaaaccacgccatttctgaccagcatcggagttacctgctgctacctgctgagcattgaaactcttatttggttcttcgccattactatcactatctgccataaaatttggaacatctacctgacttttggatactgccctgtcaaagttattggcaaactccaaccccatctttgattttggactaatatatgctccttctaagccagaagctgccattacgcccaaggaaaacactcctgtcactgccattgctgctgcaaacagaaagaccattcccttttttaatatcatttttatcttcatagcttctctcctttatcttcttattttatttataaggctctgttcgtttatggtggtcctcgtatcacagtacatttcttcctttctctgtttaaaaatgggtacaaaaaaaggacattctttcgaatatccttttccgtactcaattttctattttttaatagttactttttttccaacaccttttactctaaaaagtctcttataagcttttaactgtttctttggaactttaattactgcttttttattaagtcctttaaatgcctgttttccaactcgactaccagttaacttggaagtttttactttaattgtctgtaacttagaacatccataaaatgctctttttccaatgctgttaacatttatacctatcgttactttctttaattttttacaattcttaaaagcattcgctgcaattcctgttactttatatctttttccgttaagctttatcgaagatggaatagttacagaaataatatttttcttaacaggttttacatactggactgtccttttagattttgaaataatcttgtaatagcttccttttaatttctttgtctttactgtgctttttttacttcctggtcttgtaatcttatttgttttcatatttttcgaccatgtaatccgaccattttttacttcaagagcatatccgccggcataacagtttcccgtatattctttaggaatatctgatttagatttccaattcggaagatataaaagtgtatctgtatccattccaattacatcagaaacaacatattttttagttgcctgcaaacttcctactttaactgtcactgtggcaatcccatttttctttgctgtaatattcccattagagtctacggatactacagatgaatcagaactactccacgaagcacctgtatttgatagtttacatttaaaacgacaaagttcattatgaactttaccaaatattactggatgttgccatacacctggatgagccttccttttctctccttttttaatcacatcataagtatactttggagttaaacaattttcattagcatctacaattaaataggtattcgatgaatcaatatacaaatccatctgagtccgaacagtttttccattatttacatatggattgtaatttgtatcatcatgtccaacttcattactgataaaacaatatgttacattacaaaaaccgccatagttaagttctcttggtattccctgtggtgcatctgtagcaacaacacctatccctattttagaagtaatatcactctctttataaaggaaagtacctacttttttgatatgatttaatattttttcttttccatttctagtttctttccataaattatcgctgtattcatcataaccatctatatcgtctatttccatagcatcttttcttacatatacattattatagatttcaggattacttgctgatgcatcgcctccctgtttttgcagtgctatgtccatcgctacttctgtaaaattggcatccatttttaaatctgataaaccgttatttcttctctgcctattaatctcctgaagaacttgctccgcaatcccataaaatttttttacatcaacttttgctttcaccgttgcggcatttgcatgaattgttcccagtcccattaaacatacaaaagcaagtaatgtcagtaacaaatgccctttcttcatcgttttttctctcataacttcctcctgttccgtaccgaatttcggcacatttataagtagatttgccggagattttcggtatatttatctatcatatcactccatctccaacttttatgtttagctttaatatatcatattatttttcactattccagtgttccagtctgcttttttcagaatcttttttacgtttgtgtgtaccgaatttcggcacatattcctgacaaaatcctatagtacaccatgtcaaatctatacagaagattaacacgacacacccatatagccaatgcttaattttccacagatcataaaaataagtacacaatatatataacaacaaaaatatctgtaaatgataaagactccttctctgttcactattctttatcgttaaaagaatcggtgatatactgaccagaatactgaccgttataattagtcctctttttaatgacagaccttcacatattacatctgtttttatattctcgatcgctggcattaatgtcatgatagaaaatcgaaataattgaaatgcagcactcattcctatcccgatggatactaatattctgtctgttatttgtacaatgtccatgtcatcacctctacttatatttaatctgtgctgaatttcggtacaaaaaaagcagaaggataatatatcctttctgcttttctttcttccatatctaattgctaattctattataactcagttctttttacttttctgcatacacttactgactcctatttttcgcaaaagaaaaatttacattaaacctgacagactgacagatttattttataaaatcataaatacttgtaatctcaactttatatgtatgaccatactcaccaaacatattaatcagaatatcctacagactatttctagtaatttactttatttttccatacactttttgataatcacatgctgccgcaataaaaaaattcagcaatatcaatattatgactactaaaattaaaaattcccaatgggtaaatgccacacaccgtttacatatttccatataaaaagaaagggactttcgtatggaataatccgcaaattctatcaagttcttcctctccgttacatatctataaaatactaaagcaatgtttcctaataatacaccaaaaaaactttctgtaaaattatttttcaaaaaatatttccatattattattttttccattcctaactgatacagtgtctggtaccttcttattttttgtttctcaattgacaaacctattcctaaacgaataagtagtaaaaataataatccaatcacagttaatacaaatgtcattataacttttaatatgagattgtttagttgttcttctctctctacccgattattttcaaaataaagagaagtatttacttttgataattcaatatctgtctgatatggaattgttcctttttgtacaccaacagttacataacaaggtgaatattttccacaaatacttcgatatgtactctcattacacaatacaccatatgttaccattgggtttaatgaagcaggcatttcatctttaaaacaatggataacaccaacaatatttaaaattttttccccttcctttgtatttattgtgactgtatctccctcttttatcatcctttcttgtatattttccccatttttttgtgttgaagagtccagatcaagatctacctgtaacatttctttctctgtttttatataatccggaatatataaaataacttcattgtttttcaactttttctttgaactatgctctacttgttttagataactgccagttagattatcagaaacaccaactaaaggaccgtatatataattatctaattgctgtttttgtgtaaaatcatccctcattccctctttaacttttttcaagtatatatcatctgttttcccggaaaacatcagtttgatattagaagatattgcaactgactctacttttccaactccatataccccttttattaaacttaattgttcctctgtcattgtatcctcagacccaatatgtcccataagtcttccaaaggtataatcatccggataatttatgctggaaaatcgataagacctatatgcttcccatgtctgatacactgtcaaaagcatgaaagcagataatactgttacaagcatcactgataaaattttctcttttctctggaatatatttaagattttaaaaagattttttttatttaattttctccttctttttactatcttatattcggtctgttgctgtaattttccacgaaggggaagctttagtaaacgaataatacttataaaaaatacgaataaaattaccaatgtaaacaatactattaatcctagaatattaatccaggataaacgaagatacagttgataatttccatatttatttattattgtaaccaaaacactcggcaatgcaactccaaaaaatatacctgctataccagggaataacattacctctttctttttcttaatatatatctgaaaaatctgtgcttttgttgcacctaatattctcatgatcagcaaattttctgtttgattctttagatcaatataaagtagcaaaaatattgtgatacaacctattcctaaaataaaaaattgcaacatatttctttctaatataaacagcttgcctccagaatattctccataaacatagtcattcttcacaaattctcccctttgacaaagaacttgcagggcatctgcttcttccttatacttttcttttaacgaaataaaaatatgttttgttatggtaccgtttttattggtgccaatagattttctttttgtgataaaaaaagaaggaagttcattattttgtgttttccaatatgaagaataattttttataactcctgtaagaacaaattgatatactcctatctgttcattaccttctttatcataaaataaaatattcaagtgaatattctgacctaattcataagaatatcccaagcgagtaagataagatgcctctattgcaatctcatttgcattacgcggcatatgtccacttagagttttaatatttccaagagaaaaaaaactattatctgcgcttcctatcgcaccaatattctctccctctctatctaaaatatcccctaaaacttctacttttcctactttatcaattgttgcatttttttctagtatctgtatttcatcatctgatgtatgatatgatgcaatattccaagaaccatataacttttttctctgttcctctaaagtattttgataactatctgaataaataactgtaataaggccaaagaaaaaaacaaaaaatattacaatagctaaaattctattctggtatttagagattttcatgatttttccccttctaaagcggtatccgaaataatttttccatcttctaaaacaatcattctttgcgagagtctcgcaatttctaaatcatgtgttaccagaagaatagtctgatcaaaataacgctgtgataacaacataagttctaacagctgttcaccatttttcttatccaaattcccacttggctcatctgcaagcaaaatcgaaggtttaagcgataatgctcttgcaacagcaactcgttgttgttctcctcctgaaagttctgtagcatatttccctttcttttcatatatacctaatttttccataacagtctgaataaagtcttcatctggatctttatggtcaaggtaagacggcaaacatatattttcatataccgtcatttctggaataagattaaaaaattgaaatacatatccgatatgtttcctacgaaaaattgtccttgatgtatccttcatatcaaataagtttgttccttcaatttgaacctctccagaagttggtctttctaatcctccaataatatttaaaagtgtactcttccctgaaccacttttcccaacaattgatacaaattcttctctggcaattgttaaatcaataccctgaattgcttttgtttctgcttcattctttccataagttttctctaacccttttatttctacgataatgtctttcatattttcacttccacattttttgcaatttctttcagttcctcataagataaagatccataaatcctacaacaacattttcctgcgttccattccaggactctttcaccctttttcatcttcgtgatttcctgtatctgctctttttcattgccattgtatttaatattctctccattataaataaattgtgtaccttgacttccgtctatgtcaatttttttcttttcttctactgaaattaaatctgtatccccctgttgaacctctacaacaaatcttttgttaccctctgcattactataacaatcctgctggcgcattggcacagaaacatatctaatctctgtatatccttccggtatatcattaatagagatccatatgttgctttcctcagaattttctctttcatccattatattttcttctgtttgctcactgccagctggcatatgacatgcattaagcaaaagcatacttagtaaaagtaaaaatattccatgaactttccaacattttttgtgatacatcgctttccctcctaattttgattttatctttttatatcataaccatcttacaagaaagtgactctttatatttaataaatcgtagttgcatccatctgtggaaataaaattaaaaattctgctcctccacattcccgatttgatgctgtaattgtaccaaaatgctgtttgattacctgctgtgcaatagataagcctaatccagaacttccttcttttgtacgatctcctaaaaaatagcgttcaaatatcttattctcacgtccaaacatgaaaccctgtccattatctcttattataattttattcaaatttttttctattccataaaagatttctattttgccatttggcgaatgttctatacaattttttaaaatatttttcaatacctcctgcatccaaaaaggatcacataaccattttatttttaatttcccctgtacacttatctctatgttttttggttcagctaatatttctatgtcatttacaacagtttccactaatatttctgcagaaatttcttcaaatttcatttgaaattttttacaatcaaatttccccagattaattaaatctcttatagtgtctgtcatataatctatctgcccaagacatttacccatttccactgaaaattttgaatatctcatttctattttttcacaaatcattcgcataacagataatggagtctttagttgatgagaaacatcttccatataatgcattatcttttcattatattctatatgtatctgttgttgtttatcaatatcttttctgattttctcaatagattctaaaaaattttttgaaaaaaaatgcaggttctttttaatcggaacatgcttttttaaatataatataatttggaattcttctttttgactctgctttttttgcgtttttcctaatatgatcagtgtaaaaatcataattatagcagaataaatattaaatatcattaatttctgatacggcaaaaaaattaaagttgcatatgaattttcgtatcctgcttttttcatcaattgtatgccattataataaagatcagatttattttgactagaaaaaatcaaattaaccagatttgctgatgtcctgtaatccattgccttttccactgttccaaaaaatatcatattctgtctagcaacctctttaaatataaacattgtatatattgtcataaagataatgcacattattccaaacacagagataatccagaaaccttctttcccatagtatttttctcttttactcattaaattctcctctctgcactaaatgattccatctatacccaataccttttattgtttcaatataggaaactccattataaactcccaacttttttcgtaatcttgaaacataaactgataacgtattattttcaataaaatgctcatccatatcccataaacgttctagcaacaattcccttggcataattcttccatcgtttcttacaagcatataacacaaacggaattctgtgtcttttattgaaagttcccgtccttttttaaaaatcatattatggacaacatcaattaccaaatctccacttcttataatttctgtttctatttcttctgaccattgctttcttcttaattgcgagaaaattcgtgaacgcaatactctcaaagagcatggtttagttacatagtcgtctgctcctgccattaatcctgttactatatcttcttcattctcatatgcagtaaatataataattggatttctataaaattgtcgaatttttttacaaagtaaaaaacctgaacaatctggaaggccaatatctaaaatgcacagatcatatatccttgactgtaacaattttaatgcatcgtctccattgcctacgacctctacttcaaaatcattctcttttaaaaattcagaaatttcttctgataacattatatcatcttctataaaaagtatcataatttttactccttagtataaattatatatattttttagaatatcacactctaaattaaaaatcagtagataattttatttattttttcttcaagtcacactaatgtaagatactaatgctatgcttttattatcaattaatcaatttcttattatacaaggaggtatatttatgaagaaaacattatcccttattttaatcttaagtatgtttctatgtagtaatctttctgtttttgctatggaaactacttctaccacatcgtctacttgcaacatatataatgatgtagaatcatcaggtgctcgaattgtacataactataaaaaaacaataacaaaagtttacaaatctcgttcttccattccagattctatcaattattcagaatataataattcattaaagggcacttttagtggcagattatatttaaaatctataaagaaaactgcttctggatggcaggctacgttctctggtactttaactggaagaatttaaaatttcattattttaaatggattattaaaaatcaggagaagacttcattttttgacatcttctcctttatatatatataataatattgttctcccacaaactggttcactatgactaatcttatttaaatgttatgaatttcagtacatttttctttacgtttggttaataaattctgtatatattttatcatctctaattttttttcttctccaataagatattcatataatttttttctttcctcctctgacataccatctgttatctgatttactatatatttttgtttggaatccactgggaaaaatgttctggcataatttttcatcgtcttgcgaaatcctacaacttctataactcctttatccaataatttatttattaataaatgaatagaactatccttccatgtctttttttctcctgcaatatttacaatttccgttgctgttaaccctttcccttcctcccacaatatttccataatagccatttcactttttgtcaatctttctctcattatacttttatcctcttttctcttatattctattaaatatatttatattataatttattatataagaaaaggcaacaaatctacatgattttgttgccttttcttctttatataacagttgacactacattttgtacttgttataatatagtcaccaaacaaccagcagggtgcttttaagcttcccattctggggttcatatcagttaataaataagctgcctattccgccaagaactaagggcagcttatttatttttcaaattcagaatcgcaactatcaataacgcaaccgttaatattatattaaattcctcatatgtactcataaatatacgccccctttctggtattctccagaacaggaggcagctaccctgccggttataaagcagacctacattttacaatgttcctctgcctgtctactatatcatgtatttctttttacttccacactattttcagatgatttgatccatttattttgataaaaaggagtatctctattggggatcaagatactccttatgcacaacaatgattggggatttttgctgtgcaaatcccacctgtgcttttgaagcaacggacaatgatgccggggaatacaccatctccgcaggcgggcataaaaataggatacttcttctttatattgaaggtatccctcttaatttttcttataaatgattattttataacagcatttactaccagtcggtaatcatccccttttttctttccggaacaagtagacagcgtaaggatctgtccatcttttttcggtttctttttaatagggtagtaagcgtttttttctatcgtcatagataaccaatccagccatctgttatccttcttgtcccctgtgaaatccgttaggtatgttatacttttatccaggcagtcatatacactatatactgtatatttcattactttttccggctgatacagatatatcttgttattttttttataaaaatcttctgattcaaactcatgaagcgaaccaaacatagatcttgtacgcatattatgaccataaagaatcaaatgcttgtcctcaaacgatgtttctggctgaagaaagatggaaccggcataacagtattccccttataatctttatggagatattcattccatctgcttccctgtaaaacaggataatcaatcctagttcccggaacttttatccatccaacaatgtcgggatttattttttttaatttttcccagtctatgccgggaacttcatcacctgtttcctctgcttttacatcggatcgcaggtcttctaatattttttggtttttccataatggatattcttccctgaatgctgcccctataaagatcattgacagactgatcaatacggcaatggtcagtaggtaaaaaaaatctcttatctttcccatactgtatttttctccttattattttttgtgctggatttcagtacatttcacagatcatgaacacacatatagatttcccattttgaccatgtatttataaaattcctctgtcggagctattgacatgatccttctgtgtggtctatactggatttgctgaaaagttttcagcatgatccaatctcgcagaccgtttctaagacggtctgtttttttatcccatcttatccatatcaaaccagatagatagatagataggttattatatatattattttatatatctggctctatatattttgcaggtaactctttcgtttctggaaacgtaatctcttcgcctttagaatcgtaatttcttcgcttctggaaccgtaatcttttcgctcctgaaaaatatcggaacactaaactaccgtattctccattttaaaatcatgctgtacctgtgctttataataaagccctattgtcagcggagcattatacagcgatgctaacaggtaattatccggctttcggatctctcttgtattccggttaaggcattctatgatatactctatatgttgtacatttaatgtctttatccggttctgcacctcatttactgggatttcttcccctgatattttatatgtatccctgtctgagatataaacatttgccattatctctatcatagcatctattatatttttatccgttttgtgccgttgcatcagtatttcatattctaactgatgccgtatcttttttctgtaaaactctctcgcatgtcttttttccagaatcgtaatttcttcgcttctggaatctccccttttagcttcctttcctgtaacgcttgtctctgctatagtttcttctcttttatttccttgcatcttatccatatgtgaatcctgcttcatctgttcttcagggacaatctcttttgcaccttctttatggacagccgtaaagttcatcacataaataatgtccggcttcccctgtcctctttttttcttctcgatcagtccaacttcggaaagctgtttcattgctttgctgatcgtacgatcactgcgtcccagtttttctaccaattgtttcaaattgtatgtgatatataagcggccggtatctttttcgatccagctatttttccttgataatgccagcctggataataatactccatataatattttcgcagtatcactgatccccctgtactcctcttcctccaaaagcaaagccgggatctggtaaaagcggaaattttctccctctgtattgtaaaaatagtccaatctcatctttttttctcctctcttttcttttccaatgtaaaggggaatatcctggaaagggatctcccccttacatgaaagtatatgctgcacacaaaaagtgtgcgaattctgcctgtgcttttgcagctacggcatggtcttctccatccggcaggcagaatgtctgtaatactaatcttttatacggactgtccttcttcgtttacgcagtcctttagccatttttcaatcaatgcaggacaccgcaggatctcttcggaaaggaagtggctgatataactggaaacctcttttatatctaaagaattcatatattcctgacgggttaatcctgctgtttcttcccttccttcttccactaattcatccatcgggacggaaatttccctgtccgactttccggcaggctctttgcagtctgtttcttctgtttctatttctggcaccatatctctttgttcttccctcctttctacaagctctggctcttctttttcttcttttgggcagtactggtcaagcagggccacataccgttcccatgtaatggatttctctgagatactgatgtttttatccgagcaggagattctgatctccccttgtgatatttcataggaagtactcccatatctcccttttaagaactttacaagtgcttttctggagacagtagacctgtcatattcatctatacccaacagccggtacgatacccgtatctctactgcacccggttctaaattcttctgtttatattcttctatatccacattttttgtgatcccctgttcaatcacttccttctgcatcttttccggcagcctcgccagagtgagtgcagcagatttttctatctccccttccttaaatttttccattgcctctggaagtaaatttctggagatctgctgatattcctgtactgtagcccttgcgattcccattttttttgataagcgttctaccatccttcctttctgtaaagatggagggaattcttctggatgctctcttaaaagtttttccatctctgtgatctcatgcatcaactcatacggttttttcgtgtggtatccatttgaagccattacacgaaaactttcctgcaccgcactgacattattaacaatgcatggaagaaaagcaaattcttttaatcccctttcctcaacaagcaatttacaagcctgacagcgcttatgtcctgcaataatcttatactcatctgtatctagcttgcttactgataaattctcaatcacttctcctgtagcctgaattaaatctgcaagtgattctatctcttccttatcacgtgccggacaatactgttctacattttcttttaattttgagtaatggatccatttgattattctgcgtggatgctgctcttctttttttatctcttccttgttaaatatattcccaagctttgccataaccgataccccctaatcctcaagaagttcttccaccagatctacaaaatcctgtgctacattactcataacacgatgctttgccaccggcttataaagggataacgcattatcaacaatcgctgtacggctgatacatgactgcataaacggataatcatgcttagcgatcagatcctctgaagataatttctgtgctttggtgttcgacaccatgtttgcgaatatcttccattccaaatctggattgttttccaagatctcatggtaagcatcttccaccattgtaagattatcccggcagaagttatcaaatttcactggggtaaggaacacatccgcagcatacaatgcattcattgtcagcatatcaaatacagggcgggtatcaatcaggcagacatcatagtctttctttaaatatcctaacgcttctttcagtctccacggagttttttgctctgtgatcttaacagagcctttcacaatatctatatcctggtattttgtgcgatagactgcactatttatccctttaggattctcaagaacatctcttatcgttttactgtatccgtttacctttgcaaaaaatcttgtacagttacattgtggatccaggtcaataactaatactcttccacccatttccgaaaatgtataagctacgtttactgttgtggtggtttttccaacgccaccttttaaatttgctactacatatactttcattttgtctcctcctataatttaataaaaagaatactccttgatggaatatattatataaaaaatagagatacctgttttttacaagtatccctatattctatcaattatctgatagctctctattcattttcatatttaagattctttgtgtccctcgtaccgaggtctaacgctacaataacagttatcttgttcacaatctctttttttctgtgattttcattaactgtattgaaattataatattctgcaaagtgtgtaaattcaaggatttctacatatgatcgtcttgtatctcttccatcgggtcgatgtgacttaccgccccatacatatctcttccgactacctttttatcttctctttccttctcaataagatcactcagcactctctttacctgcgcagacttcgcaatattctccagacggataactggggtggaacggtcttttgtgtgaagctcaatcgttcctgttccaaaaatacgctgtggaagactacggtataatgtaatatctgtaatacgatataacagacactcatcttctcttgaagaaaggaatccgctgtttacatataatcttccattccccactgtatattttgtaaaactaatcgggaaccataaatgatgctttctgtcctcccagatatttgctgtaacttctctgatttctccattttctgcttttcccataatatgcctccttctatgttttcgttcttttatccaacatatcatattgtcatttaccatgcaagtatctgaccgaaaaatcatatgttgttccttttctgtcatagctttttaatctccatgcaggtatgcccgatgttttgacattcccttcttatctatggtatcatgaaaaggctgcaaatcccactgtttttcagatatttttgccgcaatattattctagactcaggaggaacttattatggcttttgatggcgttgtaattgccaatattgtatatgatatgaaccgcctgcttaccggcggacgcatctacaaaatctatcagccggaagcggacgaactgcttcttgttgtaaaaaataataaagaaacctatcgactactgatttctgctggagcaagtcttccacttatctattttactacaaagacaaaggcaaatcctatgaccgccccaaacttctgtatgctgcttcgaaaatatattagtaacggaagaattatcgaaatcacacaacctggtatggaacgaatcgttgagatcacaatcgaacatttaaatgaacttggtgatacctgccgtaaaaaaatggttatcgaaatcatgggaaaacacagtaatattatttttattgatgaaaaaaacatgattatcgacagtatcaaacatatttccaatcaggtaagttctgtaagagaagttctaccaggaagaacttatatcgcccctccaggaaagggtaagatttctcttaatgatctatctgttgaatggatggaaaatacactgcttgtcaaaccagtttctgtgcaaaaagcagtctatggcagtatttccggtatcagtcctgtgcttgccaatgaaatctgctaccgcgccgacatcgatggagattctgctgttgcttctcttaccccagtgcagcaaagttccctttacggtgaactcgtccgtctgaaaaaccagatagaaacacacgctttttctccaaatattatttacgaaggaaaagctccaaaagaattcggtgcggttacattttccatgttcagtgatttaactacggaagaatatccttccatctctgaagtattagaaaccttttacgcacaaaaagaagttgtgacccgtatccgccaaaagtccgttgacctacgccatatcgtgcaaaatgcgttagagcgtactgcgaaaaaatatgacctgcagctaaaacagttaaaagatacagacaaaaaagaaaaatataaaatatacggagagcttcttcacacttacggctatgaagcagcccctcatcaaaaagaattaaagtgtataaactattatgatggcaaagaaatcacgatcccacttgaccctgacttaaatgcgatggaaaatgctaaaaaatattttgaccgctatggaaagttaaaacgtacttatgaagcattaagtactcttacaaaagaaacctttgccgaactatcacatttggaatctgtaagtaacgctttagaaatcgcccgcgatgaaaatgatcttgctatgatcaaagaagaattaatcgagtgcggttacatgaaacgtcatggcagaaatcaaaaaaaacgtcaaggcaaaagtaaaccgcttcactatatttcttctgacggattccatatgtatgtcggaaaaaataacttccagaacgacgaattatcttttaaattcgctaacggaaaagatatgtggtttcatgctaagaaaatggcaggttctcacgtcatcgtaaagctcggaactgcaaatgaacttcctgaccgtacctacgaagaggccgcaagacttgccgctcactactctaaagggaaaaatgctccaaaagttgaggtcgattacaccgaacgccgtaatctaaaaaaaccaccacaggcaaagccgggatatgtaatttatcatacgaattactccatgctcattgatccggatatcagcggtatcaaagaaatttctgatctgtagatttggtgtagatgaaaaaagaaagaataccctatcccatctgctctgtagtcgctgtatttaagatgctcatccgcatcttaaatacgctccgaaaccgcatctgggatagggtattttttcttttttctgactactctaaatccacagttggtgagaatggggactccccaaaagtccacactttctattcaaatggaaatgtccagaagaaagttctatcgcagaagaaagtcaaatagaagaaatagaactctttatataactaaatcccaagtatatacaacaatttgaatgtcagttctttagaaattaatttcccggaaagtcatatccttctggtatattccatgttcctaaactacaaatcagaatataatttttcgtattttctggaagatgctttccatgaatagtttttcctcattccttttgcagtaaggtttttccattcttctggattctttttatagacatctaaggctgcaagaattgcatctaaaaagccttccgcattataatctgtaaatccaaaaccggttcctgttttgctctttggattatagatgcttacggtatctttaagacctcctgtctttcttataatcggaaccgctccgtaacgaagggacataagctgacaaagtccacatggttcaaagcgtgatggcattaatatcgcatcgcagccagcatagatgtattttgccatttcatcggtataatctaattgcacatatactttatccgggtactgttcctgataagaaagaaacatatttcgatattcctcttccccatcacctaatacgtaaagctgtaccggcttcttcatgagacgttccatcatataagaaaagagtgcaaagcctttctgctcagtcaatcttgaaacgattcctaatgtaaatgctgttctcttctttggaagacctgtttttgcctgaagagatgctttattctttttctttcccttatcaaaggttttatcgtcataatggcaaagaatgtattcatctgtagaaggattatagatatcataatcaattccgttgacaattccgcaaagatcatcacttctgtgctgcagcacgctatctaatccctctccatattccggctgtttaatctcctccgcataagttttacttactgttgtgatcttatctgcaaaaacaagtccaccttttaaaagatttgccgaattattatattctagtttgtcgtaagtaaacatatcgtcaggaagcccggttatatcttttaaacggtcgatttccgtaattccctgaaactttaaattatgtattgtcatcacagttttaatattacgataaaatgggtcggcacaataaaatgcttttaaaaataccggtactaaagaagactgccaatcatgacaatgaataatatccggctcaaattctaagtaagacagcatttctaacactgctttagaaaagtagctgaacttttcaatatccacccacatatcataatatggagaatctccgcagaaataaaaattattctcaataaaatagtaaacgattccttcatattttaatgtcttcacagtaactgtctgcattctccatcctaaatacatcggaaatgttaccaatgtctccatctgttcacgccattttgcatcaatacaatggtaatctggtaaaacaactcgtacatcatattttttatgatttaactgctttggaagagagccaacaaccgctccaagtcctcctgtctttacaaaaggggcacattctgcactggcaaatagtatcttcttcatagtttcctccaacttgtttattatttctacccaaaattataacacaagattttgaaatttactatttaattcattaagagacagacgcccgagaagagataagctatcctatatttatgactttagtcgctacgagaaatcgtcttctatgaaaaggccgacattaaaagttattgattttgactcagttgtacaaaacacaaagtcgtcaaaatcaataattttaatgtcggccttttctaacattttactacagtctcgtagctccgaggccacaaatataggatagcttatctcttctcgggctgtctttggctagattttgtttgaattaaatagcagttgtggggatttggggaagagggtagaagttttctgcttactctcagaatatcgcagatagatatttttttatcttactattacatataggcaggttaagtcatatcccctattcccagtcattctcgagtaagcagaatacatcagcttctctccccaaatcccctcctcctgtttaattcaccttctccagcacggcacagaagccagtgaacttcataagccatatttgtggtctcggagcaagtgttggatgcgagcgcgtggagcgagcattcaacacgccgcgactaaaatcacaaatatggcttatgaagttcactggcttcgtctgtagttcgcttaatgaattaaatagtaactaagcctgcattcgatattccaggcgaagcttgtctgcaatgagtgcgataaattccgaattggttggttttccttttcctgcactgattgtataaccaaacatatcttcaagtacatctatctgccccttattccatgccacttctattgcatgacggattgccctttccacactgcttgaagttgttttatattttttggcaattgtaggatacagaagttttgtaatataattcagtaaatttatatcatttactgtcatcataatggcttctctgatgtattggtagcctttgatatgtgccggaatgccaatttctctgataatatctgtcacatcattttccagtgtattttccatatagcctgaaattccataccctttcatcaaatgctttctctctttctttttagtatcccgttccgcttccatatgagagcttgctgtctgaaaaatccggtgaagcatactgtctaaattatacggcttcatcatgtaataaagtacacctaatttacaggcgtattcaaccattgactgatttcccatagaagaaataataataaaagaaggtttcttttttatacttttatttgcatttactttttcaatgacagtaaatccatccataactggtaaaataacatcaataagaacaatatctggtgcttcatccataatgaaatgatacgcatcttttccgttatctaccacgttaatcagctgtattccttcactactctctaaaaagtctctcagattgttttttgcaaattctgaattgtctgccaccagcacttttataatcttctcatttttcatagttatcttcattttctttcctcctctcaacctctttatgcttctgcaggatattttatttttcctttatactccagacggattttatctgcaattaaagcgataaattccgaattggtcggtttcccctttcctgcctgaatgccatatccaaacaactcattaatcgtatccatttttcctctattccatgcgacttcaattgcatgccgaatcgctctttccactctagaaggagttgtctcatgcatctttgcaatagtcggatacagctgttttgtaatggaatttaaaatatccatattgtttacagacataataatggaatctcttaaatactgataccctttaatgtgagcaggtacaccaatttcgtgaatgatatttgtcacaataatttccagacggtaatccccatccttctcttctgttttttctttcagtgtaataaaatcttttctatttgccgctattttcccatttttaatctgtcggattttcttaaccagtgcattcgaatcaaaaggcttgagtaatacataatttgcccctaatcccaaagcctcttccataacttcttcctgtcccattgctgtcaaaataataaatgccggtttttttaagagattttcatctttttttacttcttcaaggactccaagcccgtccatttttggcatgataatatccaaaagtacaacatcagggtggcttgtccgaatcatggacagggcatccattccatcagaagcactcccaacaagcgtcatatcacactcccttgaaacaatttcctgtaaattctgacgaatcctctcattatcatctgcgattactacattaatgtttgacatacaacatcctcctgtaaattacaatatattacagtattattatataattcgatattgctaaaaacaatttgtttttatcgcaattatctcttttctctaatatattatgataaaaagctcaaaaatatgataaaaattactatttaattcattagacaaactacagacgaaaccattgcccccaataaggcatatttgtgattttagtcgcggcgcgttgaatgttcgctccacgcgctcgcatccaacacttgctccgagaccacaaatatgccttattggggtaatggcttctgtgctgtggctggagaagatgaattaaacaggggaggagatttggggacagaagctgatgtattctgcttactcgggaatgactgggaatagaggggatgatttgacttggctatattatattggagcaagaagtaagcttcaatttcccttttcaacttttataactttaatttaaatgcaaagcatctgttcacaataatttcagagcaagcagaaaatttctactctctcccccaaatccccacaactactatttaattcaaacaaaatccagccaaagacagcccgagaagagaaccgatatcctatatttgtggcctcggagcaaggtttagatgcgagcgcataaagcgagcatttaaatcgccgcgactaaagtcacaaatatagggtatcggttctctccccgggcgtctgtctcttaatgaattaaatagtaaattctcttgttgactttttcgattttatgtgttaaagtttttatagtttatacagttaaagtgtcaaagtattccattaaaaaactgatgcaggctgtgaggcatacagattactgatttttttcagatatgctttaacgactacaaagaaaagagaggaaaaatgtatgaaactactaatcttgattgcttattttattgttctcattactatcggttttgtctgccgacagaaggcaactgatgtgaatggctttgtgctcggaggacgttctgtcgggccgtggcttactgcttttgcttatggaacttcgtatttttctgccgttgtattcgttggttatgccggacagttcggctggcgtttcggaattgctgctacatgggccggtatcggtaatgctcttataggctccctccttgcatgggtgattctcggacgacgtacccgaatcatgacacagcatcttgactccgcaacaatgccgcagtttttcggtgagcgttttcagagtaaatctcttaagattgcggcatctgttatcattttcattttcctgattccatataccgcatctctctacaacggtctttcccgtttatttggtatggcatttcatattgattattcggtatgtattgtcctgatggcaattttaactgcaatctatgttattgccggcggttatatggcaactgcaatcaatgattttattcagggaatcattatgttagcaggtattattgccattatagtggcagtacttcatggtaagggtggatttatggctgctttagatgggcttggccatgtgagtgatcctacggtctcttccactccaggagtcttcggttctttctttggtcctgacccagtcagcctcctttctgttgttattttaacttcacttggtacctggggccttcctcagatggttcagaagttttatgcaattgataatgaagattccattaaaaagggaacgattatttctacaatttttgctttagtcgtttctggcgggtgttatttcttaggtggttttgggcgtcttttctctgataagattgatatcgctgctaacggttacgattccattattccaactatgcttgaaaatttacatccattacttattgcattggttgttatccttgttttatctgcttcaatgtctaccttatcttcactggtcattgcttcaagttctacgctgaccattgacctgatcaaagataatgttgtaaaggatatgagcgataaaaaacaggtattatgtatccgtgtacttattgttattttcattgcaatttctgcgattatcgccgttatccagtacaagagtgctgtcacatttatcgcacaattaatgggaatctcctggggtgcacttgcgggttctttccttgcaccattcctctactccctttactggaaaaagacaacaaaagctgcctgctggacatcttttgtgtttggatgtatgattatggttctgaatcttgttgcaggctctcattttccagcattgttacaatccccgattaactgcggtgctttcgcaatgcttatcggattaatcattgtccctgttgtcagtctcttcacaaaaaaaccagacgcagcattaatcgagaatacatttgcctgctatgacaagaccagtacagtaactcaaaaaactgcacttggaaaataaatgaggtaatattatggcaagtaaaaatacaaacattgtatccaaaacactggttgaatcctatattcgcaaacaggtaaaagcattaaaacaatctcctgcagagacgattgatactctcacaaagcagcttttagataaaccaaaaggctctttggaaaagtatcttttacatatcacacctgaaaaacttcaggatacacaaagtggatattataagcttttccatgatattcttccaaaagtaaatacagatcatctcgttactttaggaatgaatattggatataatggtatttttaccgcttcaaaaaaaacacaaacaaactccccagagagcaaatcagacgctctctgggcttttatgctttccatcgatggaattaattatgaaaaaaaatctgcacaatataaggcacagattagcaatgcaaaaaagaatggaacccgttgctttatgctttttattgaaaaaaatgcatggaaactgcttcctcttataaaaaaagaaaaagactgtgctttctttttattctgccctagctcctgcttaacagaaaaattcttagatgccgtaaaactcaccaaaaatctttttatttctgttgcttataacagtaacggcaataaggagcagatactttccaccaatgtatttaatcgtcttagatcacgaaaactgccttatggcatacattattattattctgtgtctgatctagataactttaaatctggcgaaatctttaaaaaattaagtaaagaaaaacctctgttctccttctttctcccaaaaaaagctgactctggtaaggatactgtaacagaagaagagaaaaaagctgtttacgaaataatcataaaagaacgatattggttaaagtatccttcaatcccatttgaaatagagaaagattattactatttaattcattaaagaacagaagccattgtcctcaataaggcatatttgtggtctcggagcaagtgttggatgcaagcgggtaagcgaacattcaacacgcagcgactaaaatcacaaatatgccttattgaggacaatggcttcgtctgtagtttgtctaatgaattaaatagcaactaagctctattctgttgtgctaccaagtattctgctccatattttttacggagtgccggtttttcaatctttccagttgcatttctaggaacatctgcaaagataagcttcttaggccgtttgtaacgaggaagcttcatacagtattcgttgatttcttcttcagtacattccatgccatctttaatagaaataaccgctcctgtaatctctccaagtcgtttgtctggaagtccgatgactgcgacatcttttactttatcaaaggcacttaagaagttttcaatctgtactggataaatgttttctcctccacttacgataacgtctttcttacggtctacaaggaaatagaatccgtcttcatcctgcattgccatatctccggtaaagagccatccgtctttgatagtttctgcggttgcttttggatcgttgtagtagcaggtcatcattcccggaccctgtacacaaagctctccgacttctccctgtggaagtgcatttccattctcatcgacaatcttgcaggaccagcggtaacctggaatgccaattgcaccaactttatcaatattttcaataccaagatgtacacagcctggacctgtagactctgataatccatagtttgtatcgtataaatggttcgggaagtattctttccagtgtttgatcagtgatggcggtactggctgtgcaccgatatgcatcagtctccactgggaaagctcataattctccagttttaaatcacctctgtcaaggctgtctaaaatatcctgtgcccacggtactaaaagccatacgattgtacaatgctctttcgatacggcatcaagaataatctccggtgtggttccttttaataatactgccttacttcccgcacaaaggcttcccatccagtggaacttcgccccagtgtgatacaatggcggaatacataaaaatacatcatctctgtttgtcagatgatgtttctgctccatctgtgccgcctgcagtaaactctcatgattatgaaggattgctttcggaaatcctgttgttcctgaagaaaaataaattgctgcatcatcttcgtcttctaagcgaactaacggagcctgacttgaacaatctgctacaagttctcgataactttctgcgaatgtcggacagccatctcctacataaatcaaaagacgccctttgctaagttcttcctcaattgcttcaattcgaccaataaactccggaccaaagaaaagcacatgtacctcagctaaatcggcacaatatttaatctcatcagaagcaaatcgaaagttaaatggcacagcgattgctcctgtttttaaaataccaaaataaattggcagccattccagacagttaaacattaagatggctacacggtcacccttttgcacaccacggcttaacagcatatttgccacacggtttgccttctcatcaaatacgctccatgtaatctcacggcgatatggtacagaagaagtttgctgcacaagatcatattccttccatgttgtctttcttgtatccttcattgtaggattcaattctactaaggcaacttcctctccgtaaagcttatgatttctctcaagtaaatctgtaactggcataacgctaccttccttttcttaaaaatttaaatatttaaaatacagacacccttttctctgcgtctgtatctcttaatcttcctaatccttcttcactttttctcttttatttattaaagtgttgcactatgataaagtatcatattttgtgaaaaaagtcaacgctatctcgctattccagctctttttttatcagttcaaaaaatattttatatgtgccttgtatacaagttttttctgtaaatcatctggttgatttacgatgcttcgttgacagatttccttttttgcactatcattatatggtaaaaataaacagaaacgaggataaagctatgttaaatgaaaaaatggttgctctcggcacccagcgttctgttatccgtgaattatttgaatacggaaaacagcgtgctgccgaagttggtccagagaatgtttttgatttctccatcggaaatccaagcgttcctgctcctgattgtgtcaatgaaactgctataaagctccttaatgagatggattctgttgttcttcacggctatacaagcgcgcagggagatgccggtgtccgcaagatgattgcagattctatcaactctcgcttccagacatcttttaatgcagataatctgtacatgactgttggtgccgctgctgcattatgctgctgcttaaatggtcttacatgtcctggagatgagtttatcgtatttgcaccatatttcccagaatataaagtatttatcgaggctgccggtgcttctatgaagcttattcctgcagacatcgaggctttccagattgattttagggcatttgaagaagccatcaatgaacacacaaagggcgttcttgtaaactctccaaataacccatctggtgccgtttattctgaagaaactgttaagaaacttgcggaaattcttgaagcaaaatccgcggaatatcatcacccaatctatttgattgctgatgaaccataccgtgagattgcatttgaaggtactgtcgttccttaccttcctaaatactacaaaaacactttagtatgctattcctggtctaaatcattatccctccctggtgagcgtatgggatatgttgtcgtaccagatgaagtggacgaacatgaactggtttacgctgcgattgcaggtgcaggacgttctcttggctatgtaaacgctcctggtttattccagagagtctgtgctctttgtgctagcgaaacttctgatatttccgtttatgaaacaaataaaaacattcttacaaagggacttcgtgatatgggataccacgttgtagaaccaggcggaactttctatatgttccctcgtactttaatcgatgatgatatcgctttttgcgaaaaagcgaaattagatcataatctattaatcgtaccgggaactggatttggatgcccaggacacgcaagaatttcctactgcgttcctacagaacaggtagaacgttctcttgccgcatttgagaaactcgtaaaatcttataaataaactcactgtcattggaggcagacatgatcatagattttcacactcacacttttcctgataagtcttcggaaaagattgtgaatcatcttgcacacattggctgcattcctccacatacagatggttctgtcatcggtctcttttcttccatgaaagaggccgatattgattattctgtaaatctacctgtcatgacaaaaccatcccaggttgaaaaggtaaattcttcattaatccaacagcaggaatatctgcttgatatgaaaatcattacctttggaggtatgcatccaaattatacgaattataaagaagaacttttacgtttaaaacaggccggaattcctggaattaaactccatcctgcatatcagaatgtagatcttgatgatatccgcatgatgcgtatcattgatgaagcttcttcacaggggctgatcacattagtacatgctggcattgatattggtatttatgaccacaattattcttctgttgctcagattttaaaattattaaaagaagttgccccggagaagctggttcttgcacatatgggaaactggggtcgctggaacgaagtcgagagtgatcttgccggagcgcctgtctattttgacactgctttttcttatggcccggtaactccactccccgatgccccaagagctccgtatatttcctataatcttcatccaaaggactttgtacgtcttgtgagaaaacatggtacagacaagattctttttggcactgattctccgtgggagaaccagcaggattatgtgaaacgaatctctcacatggactttacaaaagaagaactcgaacaaattctttctgaaaatgcaaaaaaactttttactatttaattcattaagagacaaacgcccgagaagagaaccgctagcctatatttgtgactttagtcgctacgagaaatcgtcttctatgaaaaggccgccattaaaagttattgattttgactcagttgtacaaaacacaaagtcgtcaaaatcaataattttaatggcggccttttctaacattttactacaatctcgtagctccgaggccacaaatataggctagcggttctcttcccgggctgtctttggctggattttgtttgaattaaatagtggctgtgggaatttgggggagagggcagaagttttctgcttgctctgaaattattgtgaatagatgcttggtatttaaattgaagttataaaggttgaaaaggagaattgaagcttccttcttgctccaatataatatagtcaagtcagattatcccctctattcccagtcatttttgagtaagcagaagacatcagcttctgtccccaaatcccctcctcctgtttaatccaccttctccagccacagcacagaagccattgcccccaataaggcatatttgtggtcttggagcaaagtttggatgcgagcgcataagcgaacattcaaaccgtcgcgactaaaagcacaaatatgccttattgggggcaatggcttcgtctgtagtgtatccaatgaattaaatagtaaatttattttattttgatttttacagtatgttttttcccgcttccatcagttgccattgctgtaatttttacagttttccctttggctgattttttcgttgttacgattcctttggcatttacggtggcatattttgcattacctgatgtccagagaagttttgtatttgctttctttgtggcaattactttggcttttagttttagcttcttgcctgcttttactggcttactccccgtaatcttaactttctttacaatgcctttcatagatgtaatcttccaggaagcatattttttactgccatcttttgctgttgctgtaatcgttacttttttaccacctgttttctttttcagggtgactataccattttgggttaccgttgcaacttttggattactggacttccagattagctttttattggatgcgttatttggtaaaactgtcgcttttaaagtaagctttttgcctgcggcaatttttttggaaataccggagagacgaatagaagatactaaccttctattaccatttgtgtctatattcggttttgtgttctggtcactgcctgaatacaaaatatctccactgaagttataattgtaaaacattcttccggtaggtactatctcatacttatccagaatggacattggctggttttgttctccttctactggaattgcataatttttattagctttctttttaattttataaatagaacatacttcttcatttttttgctgatcataatcaaagtatgctacataatccgacactgtacctgaagatgtctttttatttagcatcatcaagctgtatgatgttacagatgttgtatacgcttttattttctgtgcgtttgtgtttatagtaaaattgctcgaccagaaataatttccattttcatcctgcatagaagcaagccaaatttcagggaaaacttcctgtattttataaatattatagtatggttcatcgtcactgcttcctgcttgtcgtaaagccccatatatccctgttacagaatcgtcttttggcgtacatggaataaagtctgccagctcatagactgccgcagtcatccgttttgcttctttttgtgatgttttctgtactttttggtttaatgtatcatttccttcaaatacaatgccatcttttgctgcggcagaataagaaacaactatagaagaaggaaatttattatcacgatacacttttaaagtaaccccttgttttactttaaactgtgcgtttgcctcttctgccattaaagaaatcggttccccctgtactctgtttttattaatctctaaggacccatttccttctaatgtaaggcttccgccataagagtaaccccatacagcaattccctgtatctgattattccccactacctttactttaaaatcatcccccatttcatttgccacaattttcttttcagcttcctgatatccgtttaaagtaagagtatttgtttttttatcatagctgatgtttctaactgtgctgatagtcactgatttattggcgttataaagctgtttaggatttgcacttccatcatcaatcactatatatgcactactccaatcctgctcatttggtccatttgccgcttcgaccgaacttcccagcatcacaaatgacattaaaaacgcaaaacaaagtgccattatctttttccatcgtttcatcgctgttcctcctttatccattgatactttgttttttgataattacattatacaaaattccactctatattttctgattctttccagttagtcattgccaaaacggaaatcatactttatgggttttttgtctgctgcttttacgatataatagaattaaatgaaacctttcaggattacaaaatctaccacataaagcctggtacataatcttcgattcatttaaacttttaatttaggagaaggtaagatgaccgattttaaagatattttaataaaatatatggaagaactggattgttcctcaaaggagcttgcagatagttccggactttctgccgcaacgatcagccgctatcgttccggagaacgaatacctgatgtagaaagtgacaatttaaagcaactgatttacggtatcgttaaacttgcccaaaaaagaaatctttcttctattaatgacataacggtacattctgattttctgcgttttttaccggatatatcggctgatttttctattttgcaggcaaatttgaatactttatttactatgctgtcaataaatacttcagagttcgccagatttttaaattatgatgcctcttatatttcccgcataaaaagcggcgaacggcagcctgctgatccagaactctttcttgttaatactgctctttttgtaacaaaaagatatacgaaaaaaacagatctttctatattagcgaatttatttgattgttctttggaagaattgcgagaggaaaaaacgtatttatctcttttaaaacactggcttcaaacaaagcatacgaatacagacaaagagcagcaatctttatcccattttctgcaaaaattggatgaattcaatttagatgactatattcgtgttattcattttaatgaattaaaagtcccaacggcaccttttcagtttcccggttctaaaaattattttggattaaaagaaatgatgaatagtgaactcgattttttaaaagcaacggttctttccaaatcacaggaagatgttattatgtatagtgatatgcctattgaagagatggcgaaagattctaattttcccaaaaagtggatgttcggaatggcctgtatgctaaaaaaaggattacatttgcatcagattcaccagattgaccggccgtttgccgaaatgatgcttgggcttgaaagctggattcctatgtatatgacaggtcagatttccccttattatttaaaagaaaataccggacaaactttcatgcatttattaaaagtttccggagctgccgcacttcagggtgaagcaatttatgggcatcacacacaaggacgttattatctcacaaaacataaaactgaaatatcttattacaaagaaatggctgagctgcttttaaaaaaggcttctcctctcatggaaatatttcgggaaaactccatgatgccctatcatgcttttttacaggcagatgcaaagaccagcggaaaacgatatcacattttatctgctttaccgcttcaaactttgaattcctccctacttgaagatattttaaatcagaatcagatcaataaagaagatgctcaaaaaatcaaaacatatattgataaaaagtctgctcagattcagcagattctttcccatgatatgattacggaagaattccctattttatccaaagaagaatttagtagatttccgattgcgcttccattatccgatattttttatgaagaaaacatctattatacctgggaaatgtataagcagcatttagaaagcactctaaattatgaaaaaacacatcaaaactattgtataaagcaaaatcaacaatctgcttttcgaaatattcagatcaggattcacgaaaaaaaatgggttcttgtatctaaaaacagaacccctgcaattcattttctcatccggcatcctaaaatgagaaatgcttttgaaaatatgatcataccaattgtagaattatagaaaataaaaaatatcctatagcagctaatatcacagctactataggatactttttatttttctttctaagattatttattatagagatttctcttatcgactactcgaacagcttttccttcgcttcttgtaatagtttttggttctaaaatgctgacatctaccttgattccaagcatgttcttcaaaccatgtacgattttcttttctctagctgcgatagcgacatcttcctgtttcatttccggtgtcatctctacctgaacttcaattgtatcattattgccaatacgatctactaaaatctgatagttagcctgataaccctgttttaataaaacagcttcaatctgagatggccatacgttaacaccttttactaccatcatatcatcgcttctgcccattggtttatgcatacggatatgggtacgtccacaggaacatttctttctcgtcagataacataaatctcttgtgcggtaacggagtaatggatatgctttttttgtaatacaggtaaatactaactctccgatttctccttctggaagaacttctcctgtatctggattaataatctcaggaatgaagtgatcttcctgtatatgcattcctttctgctcttcacattcaaaggatacgcccggaccggaaatctcggtcagtccataaatatcataggctttgataccaagagattcttcgatattatgacgcatttcctctgtccatggctctgctccaaaaatacctgcctttaacttgatattctctctatgtccgccttcattaattgattctccaaggcttgcagcataagaaggagtgcagcaaagaatggtagatcctaaatcttccataaactgaatttgtctttctgtattacctgaagacattggaagtgtcatacagcctactcgatgagagcctccatgcagacctgctccaccagtaaagagtccataaccgtaggctacatggcatacatcatcttttgttccgcctgctgccatgatagcacgggcacagcagtcttcccacacatcaatatcttcttgtgtgtaaaaggcaacaacacggcggcctgttgtaccacttgtagactgcattctcacacattcagataatggtaccccaagaaaaccgtatggatactgatctctcaaatcatctttagtaacgaaaggaagtttatgaagatcttcgattccttttatatcttctggttctactcctgcttctttcattttattacgataaaattctacatgatcatatacatactttacctgctctacaagcctttcgctctgtaaagcctgcagtttctctaccggcatcgtttcaatctctggttgataataatttcccattcttctctttctcctgttgtcacttaatttataatgatctctttctcttctattcttcgcctcttccaagtgcaaatgccttgtgattgagttcaacaaactttgccggaacacattcctcgattgctttctgccacttttctaccggaatatcaaagtatttagacagtctgcccattaaaacaatatttactgcttttgatgaacctgcttcttctgctaaggacagacaatccatcgcatctactttaattcctaaagcttccatcttttcgataagattttcagggtactgtgccgcaccgataataaccggcatcgggtcaatttcctgtgtatttactacgattcttccgtctggtcttaaatattctacataacgggcagcttctaacttttcaaaagaaacaatgaaatctgcctctcccttatcaataattggagaatatactttctctccaaatcttacatatgtaacaacgcttccacctctctggctcattccgtgaacttcagaaacctttacgtcatagccttctgataaaagcaaatgtcctaataacttgctggcaagaagggaaccctgtcctcctacaccgacaatcataatattctttgtcatttcgcctgtcctcctatgcctgtaatgcgtcaaatttacataactgctggcatacaccgcagcctacacataatgtcgtatcaatgactgcctttttgtcctttacactgatggcaggacatccaagacgcatacatgatttacatcctacgcagttctctttttccacttttaatggtgggttatgttttacatattttaagagggcgcaaggacggcggctgatgattacagatggttcttctgctgctaattcctctttaataactgtatcacaagctgcaaggtcatatggatctaccacacgaacacgattgaatcccatagaacggcaaagactttctaagtcaatctttcctgccgggtcacctttaatattgtaaccagttgttggattctgctgatgtccagtcattccagtgatagagttatcaagaatgattaccgtagaattactctgattgtaagcgatattggcaagtccggtcattccagaatgcatgaaagtagaatctccgataacggctacagtctttccttcgctttctttgccaagtgccttgttaaatccatgaatagaactgatggaagcacccatacaaagcgtcatttccattgcactaagtggtgcaactgctccaagtgtataacatccgatatcgccgagaacagtacatttatttttagataatgtaaagaataatcctctgtgcggacagcctgcacacataaccggaggtcttcccggaagagcttctccaagttctttatgtgctggaacttctatacctaatttttctgcgattaaattctgtgaaaattcaccttccattggaagagcatcttttcctgtaacagtaagtccaagttctttacaatgattttctaaaataggatctaactcttcaatgattgcaagcttttctacttttgcagcaaaatcgagaattaactggtctggcagaggatttacaagaccaatctttaagatacttgctttatctccaaatacttcttttgcatattgatagcaggtagaagatgtgataataccaagctttgtatctcccatctccacacggttaaaatcacagtgatttccatactcgataagctttcttgttctctcttccacaactggatgacggcgaatcgcatttcctggcatcataacatactttgcaatattcttctcgtatggaattgtctctggtacaacacgctcgcccggctctacaatactctgtgaatgagctacacgggtacacatcttaatgataactggtgtgtcaaattcttcagaaagttcaaatgccttctttgcaaactcataggcttctgtggaatctgatggctctaacattggaatcttggatgcaatcgcatgatgtctggaatcctgttcattctgagaagaatgcattcctgggtcatctgcaacacagataaccataccgccattcacacctgtataagagcaggtaaataatgggtcagcagctacgttaagcccaacgtgcttcattccgcaaaaacttctctttccagcaagagatgcaccaaatgcaacttccatcgcaaccttttcattcggtgcccattcacagtaaatctcatcatattttgcagcttcctctgtaacttctgtactaggagttcccggatagctggacacgacactacagccagcttcatataagcctcttgccaatgccttattacctaacattaattgtttcatggtaaaatatcctttctattgtttattgttcctttttatagaaagatacgaccgtcctgtacagtcgcatctaagtatatctgacgttgtaacacatttaaaaaactaagattctttagcctcttcgcttccctctttttggttcagtctgtcaattacctctccaagacagcctgttccataattaagcatacgatttacacgactaattgtagcagaacttgcgtttgtctcactcataatctccgtataaactttttccttcttcaacatacttgcaacttcaaagcgctgctccatagaccgaagttcagtcattgcacaaatgtcttcaaaaaaatcaaaacattcttctaaactttttaactccagaatagccttatacatgccttctttacgttcttttggaatattttttcccataagatgttccttcctttacgaaatataatcttataataccatctttttttaatttcgtaaataaaaagtttaatgtgttaaagagattttcctttaaacaacaaaaacactataataattcccttgactcgctttttatgctatacttaatctatctttttgataatgaggtttatttatgaatttggaacagtatacaaaaatcaataattttttcatcagacactccactgctttttcattattactcacggcaaatcgattattgactgcctgtggttttctcctttatccattattattactatgtcttttaacaaaaaagaacattgctatgcttattagttttatcgctatcccagcactctgtttcctggcagtaaccatttttagaaaagtagtgaataaaaagcgtccatatgaaaaacttccaattcaatccctaattaaaaaagataaaaaaggccagtcttttccaagccgccatgtgttttctatctttttaatcgctacattatggttttgcttttggaaacctgttggaatctttctttttattgctggtgtctttcttgcgattgtcagagtaattggcggggtacatttcgtaactgatgtatgcgccggggcactcctcggggtgctggcaggattgatttccaactatgtctttttgattagctaaaaaacagacgaaaaaagcccctattaatcctcccagatgtgactttagtcgctacgtgttgaatgttcgctaaaaggctcgcatccaacacttgctccgaggtcacatctgggaggattaataggggcttttttctgttttttgataaattaaagtgagaattgcagaaatctaattcctgcttttttaaatgtggacttagaaatgctttctatataaattttcacataatatatattatacttataagaagttttatttatagcaaaactatataaaatgccagtgaaacattaactataacgaagaaaattttccacccactcccatcctcttctggagaatcctcaaatcctccacagcggaatttgcgccaaagtcagaaaatgaaaatgacttataatagcagatgtgacctcggagcaagtgttggatgcaagcccttaagcgaacattcaacacgccgcgactaaagtcacaggtgctattataagtcttttttattttcgtctacctagccaaattccgctaaatattattcgttatctaaagctttgatgcttaagctgatcttacgatcatctttcttgaaatctacaactttagctgtaacttcctgacctacttttaatacatcagatggtttctcgatgtgctctttagcaatctgagaaacatgaagtaatgcatctacgcctggctctaattcaacgaatgcaccgaagtctgtcatacgagcaactttaccagttacttcgttacctactgcgtatttttcgtcagcgtgaagccatgggtttgtttcagggaattttaaggataatgcaatcttttctccctggatatctttgataagaacgtttaatttttcacctactgtgaaaactttcttaggattctcaacacgtccccagctcatttcggagatgtgaagaagtccgtctgctccacctaaatcgatgaatgcaccgaaatctgttacgttctttacagttccttctacagtcataccagcttcgatttttgcaaacagtgcttcctgttttgctttcttctctgctactaaaagctgcttacggtcaccgatgattcttctcttgcgagggttgaactctgtaataacgaactcgatttcctgtccgtcatatttctttaagttcttctcgtaagtatcggatacaaggcttgcagggatgaatactcttgtttcttccactacaacacttaaaccaccatcaagaactttagctacaggagcttttaatacttcgtggttgttaaatgcttcctctaatctcttattacctttctctgctttaagtctcttatatgttaagagaacctgtccttcgccatcattcactttaagaactttagcttccatctcgtcaccaactttagcaactgttgttaagtctaaattctggtcgttggaatattcgtttcttgaaatgataccgtcggctttatatccaatatttaagatgatttcatcctcttttacatcgataatagtaccctgaactacctctccatttctgattgtcttaaaactttcttccagcatctggtcaaaactcatttctgccatgctttcatgaacctccttgataatattatttggggttgaagcccctgcagtaataccgagcatcccgatattagaaaaatcctccatattcaaatcattttttgtttgtatataaaaagtattactacattcttttttacttatctcaaaaagcttttgagtattcgaactgtgtctgccaccgattactatcatcgcatcggacttcttcgccagttccctgacttccgtctgacgctcctcagtcgcattacaaatcgtgttaaaaacatttatatcataacccttttctgagataatttcaactaaatcttgaaacttattgtagttaaatgtcgtctgggacacgatagatatcttcgtatcagcatctaactcaattccttctgcctgctctcgattctcaattacaatcggatgcgtatggcaccaacccataatcccttctacttcaggatgatggttattgcctataataatgattactctgccatccccactctcccgctcgacgattttatgaatctttctcacaaaagggcaggtcgcatccactaaatcaagacccgcattaaggatctcatcataaattgcttttgacacgccgtgagaacgaataataatcgttccctctgaaagagacttgaaatcttcactgtcattgatgacatgaaccccttgtctttccagatctgcgacaacttcatcattgtgaatgatcggcccgaatgtataaacattcttcttagaagattctttatacacggtatctacagctctctttactccaaaacaaaagccagcagattttgctatgttaattttcatcatttactccggcaatattattttatttttttaaattcggagataatagtatcaatcacctgcggaattgacatatcagaagaatctaccagtatggcatcttctgcctggcataatggagcgatctctctctccatatcctgcttatctcttgctataatatcggtcttaatctgctcgatatcacagtctgcacctttctctttcaattcgtcataacgtctcttcgctcttacatcagcagaggccgtcagataaatcttaagagatgcatctggcaggacattcgttccaatgtctcttccatccatgaggatatccgaagtcttcgccatatcgcgctgcagatcaagcagtgcagctcttacttctggaacagcggatgtcactgatgccatcttaccgacttcttccttacggatatatccggtaacattctcaccatttaagataacctgctgttttccttcctcgtcatattctaaagttacatgaatgttaggacattctgccgcaacgagcttcctgtcatgtccatcaatacctttacgcaaaaaatataaagcgattgcccggtacattgctccggtatctacatatataaaacctatatcttctgcgattgcctttgcaatcgtgctctttccagctcctgctggcccatcaattgctatactgtacatggacatttcctcccattcttttgaaacctgactgcgtatacagtgatttcacttttacctacacttgattagtgtaacatatttttccgaaaaaaaaaactatttttttataattttttaaattttacgttttctttacgcatttttacctgctacgtagcctgttgtccatgcaatctgcaggttatagccgcctgtgacagcatctaaatccatcatttctccggcaaaaaataaatgttttacttttttagactccattgtagacggattaatttcttttacatttactccgcctctcgtgacgattgcctcattaaagccacggactcctgtgatatgcatctcgaaattcttcatcagctcaatcatatgccttctttcttttttgctgatgtctcttatctttttatcttccggaatctgtgcttcttctaaaaaaacaggaatcattttctttggaagaagacgttccatcacattagaaatatttttattacgataagtgtcaaattctcttaaaaaccgtttatctaactgttccggggtaagagaggcttttaaatcaagaatcagttttaattcgcctgcctctaactctttctgatattttccaagacaggtacttgctgtaagaacaagcggaccactcactccaaaatgcgtaaagagaaattctccaaacccctcataaactgtctttttctttgctttgatacgcacccctatattctttaaagtaagtcccatcaaatctttgcaccacatttctttcatctcaaatggaactaaagatggttctatagacttaatcttatgtcctgcttgctttgcaagtgtatatcccgatccattggaaccggtagaagcgtaggaaaagccgccgcaggcaaggataacagaatctcccatcattttctttccgtcagacaagagtacaccaacacagttttctttttcttcatcaaaaagcagttcttttacttctgtgtgatagtaaatctgtaccccgccttttttacactgtttctttaatgcatcaattacatccgaagaccggtcggactgtggaaatactctctgtcctctctctgtctttatcggaagaccgatttcttctaaatagtccatcatatcctcattattaaactgcgaaaatgtactgtataaaaatcttggatttgttaccacatgggtaagaaattcgtctgccgggcaggcatttgtaatattgcatctgcctttccccgtaataaaaagcttcttgccaagtttttcgttcttttcaagaatgcaggcctttttcccctctttagacgcagaaatggcagccatcataccggctgcccctccgcctacaataattactttgttcattatagtaaactcctgttataaacatcatactcgttccagagttcttcaagtgccataagacgcttctctacatcatccttacgaagcaatgcaatcgctgtaaccatcgcattcaccacacttaacggacatactaaagaatccacgattgtcattacatcactctttgcaattaatttacaatctgcatactctacaattggagactgcatattgtcggtaagtgcgattgtcttcgctccatgattcttcgcatactgaagcgcacagatggttctctttgaatatcttggaaaagtaattcccatcataacatccttatcactgatatcgtaaatctgctctaatgtctcggacgtgctgttggcatctacgataattacattgtcaaacatcatcttaaaataatatcccatcagaccggcaagataggctgcacttctcgcacctaaaatatataatcttcttgcgtcattgataagcataacggatctgttaaattcttcctcatctacaccgctctgaatcgtatcgcgaagcctctctgaatctgtatacaaaatactctttaatacacctttttcctgatatctttttgaggaaagggacattctctgaatggagtttgaatttgtctttacaataacctgaattgccttctgtagctctggatatccctcgtaatcaagctgataagcaaaacgaaccactgtagactcactgactcctgcttcctttccaagctttgaagcggtaagatacgccgcaatatcatagttctctgtaatatactgagccagtcttctctgtcctttactgaactcggaagacttcttctctattctctgtaataaatttaaatgttccactctattcttccacctattctgtaaaattaagtatatttcataatactccattttcttctttttgtaaagcaaaatgcaggatttaaagaaagaaattgcaaatgaaaattcaaatttataactacagaacaatttttacacaaagaaaaactgtgtttccgaaaaattccatccacacagtttcttttccttcaaaattactttccaggataagtaataacagactctacatcatagccttttaatacatcacggccatgcaatccctcaagttccataacaaacagaacctttacgacaacgccaccaagttcttcgatcagatcaatcgcagcctttgctgttccaccagttgctaaaaggtcatctacaaatacgattctttgtcctggacgaatgtcctctttatggatttcaatctctgctgttccatactctaaagcatattctttgcttacagtctctcttggcagctttcctttcttacggacaggaacaaatcccttgcttttattgtaagcaagaggcataccaaataaaaatccacgggattccgctccaacaactacgtcaaactctgttccctctaagcaatgcattaattcatgtacgctaagtttcagtccctccggatcacgtaaaatagaggtaatatctctgaaaataattcccggctttgggaaatctggaatattaatgacataatcttcaagttttttcactttgtccaccctttctgcccccaaatcaggcataaaactattaagcacagacttttatcttcgcgctttttcttcttatgattaattataacagattttttatgtaaaaaacaacagaaaaacgtttatttctacttacacattacaaaaatgctcgatagcgtatgctacgccctcctcatcatttgtctttgtcacaaaatctgcaacctctttcaaagactcttctccgtttttcatagcaacaccgacaccagccatcttaaccatctcaaaatcgttattgccatcgccgcacgccataatactttctatcggaatatcaagaatttttccaagattgagcatcgcatctcctttattacaagttgccccattaatctcaagattattaccaagagaacaggtaaccgccaaatcttctatctgtccaagttcacggaaagctctctgtctgtcttcttcctttgcaaagaacatatttatcttctccactggagctttattttctttcatccactctcttaaatcatcaatacgattgcgtgatgtacgaaccagcttctcgatatgtttctcaattccatagttttctacattatcataaaagcgagcctcacaccagccagctcctaatgcataaatatcataaaatgtatcatatgtttctaacacatcgaataactccaatgctctctcccacggaatacaattctgataaagaactttatcctcttttaaatctaatacacttgcaccattggataaaataacatatctcattccttcaatctgtgttaaatactctggaatacccgattttactcttcctgttgccggtaaaacctgaatcccttccgcaagacatttctcaagtacttcctttgtatgtggagttaacaccttatctgaagtgagcgttgttccatctaaatctaatcctatcaatctgacatctggctgttttttctcctgttccatattttctccttatctatctcttaattcatagcgattttgatgtatctctcttttcatcctcatattattctattgattctcgccttatttgtcaaattaggatagttttttattaattgggaatctaaacagacgaaaaaatatgcgaaagaagcactaaaaaatttatctcataaatttttaaaacgataattctggatgacgatttggatattcttctgccctcgccattcatttacctgtggataataagtcacatccatccatatatgatgtgacaggcctttttgaattctctgtgcctcttcttttccacaaaaagagatgagttcttctaaaaatacatcggattctccaaaatacatggcatctatgcttgttccattggcatccgacaggaagagttttaaacatctgcctgttgttccgagtacccgcattccttttatgtaaaggtctttttgtgcaaagagcggttttgtgttttcatttccaaatggttctagtaattcaaattcattgatgagactttcggataaataagatatcggcaaggctacatcaatgtgaactttttctgcgaaatcatcttcggtaagggttgcgttggcatttaatttttcccggaattcttctaagcggtcttcctgcatagaaaatcctgctgccatcgggtgcccaccgaatttatcgaaacattccttgattttgttcatttccttatacatatgataggcttcgatagaacggccagagccttttaatccttcttttgttcttgtgatgacaaatactggcttatggtaatgttctttcattcttccggcaataattccggcgatactttcgtgacagtttggaagatatacaacaagtaccttatcgtttgcatgtcccgtgctttcgagatattcttttgcagcttttaccccgttagctgtcatttcttttcgctctgcatttagctgtgtgagtgcttctgctttctgcctgcaaagttctttatcttcgcatagaagaagttctaacgcatcttttgcagaggtcaaacgaccggaagcattaatacacggaccgagaataaatccaaagtgataagaagatatctttttttcttcaagatgatttgcctcaattaaagcttgcagcccggtaatattcgtatgctgtatccgtcgcaggccttcctttacgataatacggttctcatcacacaatggcataacgtcacagactgttgccatcgccgcaatctcaagaaatacttcactttctctacggtcaattccaaacaaatcataaagcacctgaataaacttgtagacaacaaccgctccgcatatattttcaaatggatacggacaatctttttgcttcggattaataacggcagcggctgacggcaaattataagaaatgcttccatcttcttgcctttgaaacggaatatcatgatgatctgtcacaatcagggtgagtcctaaagaatttccataagcaatctgttctgctgccgcaattccattgtcacaggtgataatcgtatcaattccgtcctctgctgccttttctatcagatgttcattaattccataaccgtcttccacacggtcaggaatcttataatcaacatccgcaccacagcgttttaatccctgatataaaatatagtttgatgaaacaccatctacatcataatccgaaataatccgaatctttttgcctgtttctatcttctcttttatgatttccgctcccttatcggcatctttcaaaagatgagaatcatataaatcagacagagaaccataaagataacgctgcatttccctaactgttgttaagctcctatttctcatcagacgcgccgttaccgggctgatatgaaatatctcaccaattttattaaaatctgctctttttgaagcgataaaccacttttccatctattcttcttcgccttctgtatctgctaatgcagccttaatcataattgcgcattctactctcttacgctccatatcgcaacttaaatcataagaatcatcaattgttccatggaaattataagagtttgcaggacagccgccgctacagtagaatctcgcaaaacagtctttacattttttctttgtgtatacgttgcaggaacggaattcgtcacaaatatcggtacgcttgattccatcaaaaacgttaccaagaaggaatttctcttctcctacaaactggtgacaaggatataaatctccccatggtgttactgctaaatactctgttccgcttccacagccggaaagtctttttgctacacatggaccacctgtaaggtcaatcataaagtggaagaaattaaagccttttcctgctttttctctcttaatcatttcttttgcaagtctgtcatactcatcaaaaatctgtggaaggtctttttcctgaattgcgtacggctcttctggctgtccaacaactggttccatggaaatctgttcaaatcctaagtctgcaagatgaagaacatctttggaaaaatcaagatttctattggtaaatgttcctcttacatagtatttctgctgatgtctggactctgcaaaacggataaacttcggcatgataaggtcatagcttggcttaccatttcttgtaggacgcatgtaatcatggatttctttacgtccatcgacacttaaaacaacgttgtccatttctttattggcaaattccataatctcgtcatttaacagcacaccattggttgtcaaagtgaaacggaaatgtttgttatgtttttcttcaagagaacgtccatattctacaacttcctttacaacaccgaagttcattgttggctcaccgccaaagaagtcaacttcaagattatgacggtttccagaattggctacaaggaaatcaagggcagcctttccaacctttgcactcataagttcacggtgtcctttatactctccttcttctgcaaaacaatagcggcaggcaagattacaatcatgcgcaatatgcaggcaaagtgcctttactactgtctttctgctctttacctctttaatataatcttcgtaaatatcttctgtaaataaaagtccctcttcttttaaagaagttacctctttatatgcttcctcaatatcttccttgctgtaagaaagttcattttctatttcttctaagcttttttcttcatataaagcaatgacatcataagttacatcatcaacaacatgaatggcaccactgcacacatccatgacaatattatatccattatttttatactggtgaatcacgttaaatatccctttctatttcttttatagttttttatacttaattttctaaaatatatttttaatttgaagatatgtcctgctaactttaaaatagatatataatacagaacattcctgtatacaatattttcaacttacaataaagtaatctctgcaaacatacttttccatacaagagataaggtgaactgacaaaaaagacagtccaccctacttcaagcatatatcaggaagcattcttcctgttgtgctctctaattatttattactctcgcaagtctggttacctactgtacaagatgtcttgcaggcagactggcaggatgtctggcactcgccgcatccacctttacacattgtagtaccgtaagttttgtttccggtcagtgtctttacacgtttcattaataacgcctcctcacttcatgatctagtatgtaaagcatctaagatgacactttgtagattattataacacaaaccctcccgtaagaaaagaactttttagcttaacattcctccaagcattcctcctgccgcacaatacagcatcattgtaaaaaatgctgttgtatctgtcacaaatgcctgccccatcccgacacgtattactccaaaaaacaagcaatataaaacacctacgccaagcccccataaataccgtttttttatattctttttcccacacaaaaatcccccgacaaaacaagccatcacactcataacaattaaaccaattttttctacggaagcggaaagattacctttcaacatggcaaatgcaaacactgctaaaaatagcattgtgagtaatactgcaattaatgcagaaagaaacaggcctgctgcacgctccatccattttttatacgaaattccatccataggctgcaccaaaggcttttttatagcctatgaaaagggttctctgtttagaacaggagagacgaaattaagagaccgccaatatataaaaaatgcttcgtatcactgcgctcttaatgctcgtccgcattaagagcttgctctaaggcgcattttttatatattggcggtctcttaatttctgtctttgttaaactggagagtactttcaatttagcaaaaaacagatatcctatatttgtggccttagcgaggattgaatgtaaacccggaggtgaacatccaaccctcagcaatagaatcacaaatataggatatctgctttttcatttttcgtctgttatctcaaacgaaattactcttcttctgtctttgtaagatttggcttctccactgctgcaatagcatctttctgcattgggattctgcagttacggttgttaccaaattctacgattacagtgtcatccatgatgtcgatgattacgccatagaatccgcttgtagtcaatacgctgtctccagcctgcattcctgcatgcatctcgtctgctgctttctgctgcttcttctgtggacggattgtcataaagtagataatcgctccaaaaagaatgacatatgcaatgatcattgtaatagatgagcttgcgctcgcactctgtgctaataacatgtccttacctccgttattcttctatataatatattaccggtattcttcttccggtgtcaaaaaaccttctaatgtggtttttttgaactctttgtagcggtgttcatcaattgctccacgtatttcttccattaaatgattatagaaatacaggttatgaagaacacaaagacgcattccaagcatctcttttgccttgagcaggtgtctgatataggctctgctgtatgtccgacatgccggacactggcatccttcctcgattgggcgggggtctaattcaaacttcttattaaaaagatttaactttccatgatgcgtatacacatgtccgtgtcttccatttctggaaggatatacacagtcaaagaagtcaattcctctgtcaactgcctcaataatatttgctggggttcctacacccataaggtaagttggtttattttccggcagatatggaacaacttcatcaaggatatagtacatctcatcatgtgtctctcctactgcaagtccgccaactgcataaccatctaaatcaagctcactgattcttttagcgtgctcgatacggatatccgcaaaaacaccaccctgattaataccaaataacatctggtgtggatttacggtatctggcaggctgtttaattcctgcatcttttttttacagcgttctaaccatcttgttgttctgtcaacagaattctgaatgtaggttctgtctgcccgacttgaaggacattcatcaaatgccatcgcaatcgtagaaccaagattagactgaatctgcatactttcttccggtcccataaaaatatgatgtccatcaatatgtgactggaaatatacgccttcttcctttatctttcgaagacctgacagagaaaatacctgaaatccgccagaatcggtaaggattggtttatcccatcccataaatttatgaagcccgccaaactgtttgatcagtttatcacctgttcttacatgaagatgataggtattagacagctccacctgcgttccgattgtacgaaggtcatccgtgcttacagcacctttgattgctcctactgttcctacattcataaaaacaggagtctgtatcgtaccatggactgtctcaaactctcctcgtttggccatgccatctttcgttaataacttatacatatactctccttaactttacacataaatttaattttatcataaacaaagcaaatgtacaacctctatccttattttttctcattttcgtagaagttttttacgctatctaagcggctccccatattctgaagcagcagatcaagaacagttaccgctgccattgtctctacaacaacgactgctcttggcacaataatcgggtcatgtcttccgtgaattacaatttctgtatctttgccatctctatttactgtctgctgtggctgtgcaatcgatggagttggcttaaatgctgcacgaaatgtaattactgaaccatcgctcattccaccaagcacaccacctgcatgattcgttttctttttcaccgtaccattatcattataaaaatcatcattattctcagaaccagcacttgctgccgccgcaaatccatctccgatttcgaagccttttactgctccgatagataaaattgcttttccaagattcgcacttaatttatcaaataccggctcaccaacaccgacgggcattcctgtaattacacattccacaatgccaccacaggagtctaactctttcattttctcctgaagatactcttccgcctgtgctgctgcctgtgcatccggcatatataatgcgttcttatctcgttcttcttttgaaaatctattttcatcaatttgaactggcccaattgcttttgtataagcaaatacttcaatgccaagttcttttaatacttttgctgctactgcacctgctgctactcttgctgttgtctctcttcctgaagaacggccgccaccgcgataatcacggaaaccatacttcttatcaaatgtataatctgcatggcccggacggtaaatatccttgattgcagagtaatcttttgaatgctggtctttattaaataccgccatagaaattggagttcctgttgtctttccctcaaaaactcccgataaaatctccaccttatcatcttcttttcgctttgttgtgtactttgactgtcccggctttcttctattcaaatacttctgtatatcctcctcacaaagagaaaggcctgccggacaaccgtccactacaacacccacaccttttccgtgtgtttctccccatgttgtcatacaaaacaatgtcccaaatgatgaacctgccattttgtcctcctgttaaaattctatcgtcaaacagagtatcctctgtttgacttttcatcaattaaatttctactatctacaccaaatcaatcttcttctaacataaacattaatatagaaagtaatgtcattcctgccgtttccgtccgcaaaatgcggtgcccaagtgtaaccggttctgctcctgctttcatcgcaagagaaacctcttcttccggaaaaccaccttccggtccgatataaattcccagactctttttatcttttactgtttctaccacttctctggaatgtgcgattcccttggcatcctcatacggaatgagtagcatatccatactctttccatattccacagcttctttaaaagacattacgggctttacttctggaatcagacctctctttgactgcttagccgcactttttgcaatctcattccatcgctgtactttctttgccgccttcttcgcatcaagctttacaaccgctctttttgttgccatcggcacaatctctgccaccccgagttctaccgctttttgaatgataagttccatcttgtcactctttggaagtccttgaaaaagcgtaatctttaccggcagttctctcgactctccgttaatatcaataattgccgccttgacgatatctgattctatctcttctatactacaaatgtactcctttccctttgcttcgcaacaaagagaaactttttctccctttttcatacggagaacattacgaatgtgatttacatcctgcgggtctgcaatccaaatctcctcttctttaatactatcaggctgtataaaaaactgatacataaactcctccacttcattctttgccctataaggcagacataatatatcataaccgctttcaaaaaatatgtcaatttactatttaattcattaagcgaactacagacgaagccattgcccccaataaggcatatttgtgattttagtcgcggcggtttgaatgttcgcttacccgctcgcatccaaaccttgctccgagaccacaaatatgccttattgggggcaatggcttctgtgctgtggctggagaagatgaatcaaacagggggcggggatttgaggacagaagctgatgtcttctgcttactctagaatgaatgggaataggggaggatgatttaacttgactatattatattggagcaagaagtaagcctcaatttcccttttcaacctttataacttcaatttaaatgcaaagcatctgttcacaataatttcagagcaagcagaaattttctactctctccccaaatccccgcaatcaactatttaattcaaacaaaatctagccaaagacagcccgcgaagagatacgatatcctatatttgtggcctcggagctacgagactgtagtaaaatgttagaaaaggccgacattaaaagttgttgattttgacgactttgtgttttgtacaactgagtcaaaatcaacaacttttaatgtcggccttttcatagaagacgatttctcgtagcgactaaagtcacaaatataggatatcgtatctcttcgcgggcgtctgtctcttaatgaattaaatagtaaccccatctttaattactgtttttagggtgaggtttttgtccaggaggaggatatctgcttttttccccacgctgatagatcctctttcatcatagattccaaggctgattgccggattttttgtggcacaagctatggctgtttctaatggaatccccatttttgttatagctgtacgcatgcagtctgcaagatttgtgacggaacccgctagtgcaccatctgaaactagagttgcccggttgcctcttacttttacatccagtccgcctaatgtatactgtccgtctggcattccggttgctctcatgctgtcactgataaatatcattcggttcgcacccatcattttaaatgcagcacgcaccattgatggatgaatgtgtacaccatcacagataatttctgccattacatgttcactgtcagatactgcaccaacaacacctggttctctatgggtaaatgcaggcatggcattaaataaatgtacagcatgattggctccggcatcaaatgctgcttttgctgattcgtaatcggcatttgtgtgagctaaagaaatattgactttatctttcatatttttaatgaaagaaattgtattttcattttcttctggtgcaattcctatgaattttacaagattatcagaagcatctaaaaatttctgagcaatcttttcattacatggaataatgttacgttcgtcctgtgcaccttttttcacagggctgataaacgggccttccatattgattccaacaaaatctgctctctttttattttttacctttgccgaaactacagtggcctttaaagcgtcacaagcttcatctgttatattctgctgttttgcttccatattttgtgcttgttcatcttcgtctttcattttctcaccgatacagacaaaatcctcttcatattcttttttataagcagccgctgtttttaaaatattttcaagttctgctactggcagagtcattgttgcaggggcaatcgctgttacaccgacacttacctcgtattctgctatacggcgaatcgcttctttatccccgtcgcaaaaatcatctcccacacagccatgaaaatgcagatcaataagaccaggaattgcataagcgccctttccgtctaatacattgtctatatcattcttggcagaataatcttgtactgaacattgagctgcggtatgttcggtttccatattcatttttttgaatatattttctttttctgcttcggtatagatttctgtgattttatctccctgtgtaataattccgcctgaaacaaaagtacctgcttcagtatagatttttacattatcaattatcattgttatattgtctctctctttctctgctatctattttttcaatatatattcttttgcatttaatatctatatctatccggaaactacaagttctatttatttttatcaatctatatttccacttctataattttcattgcttacccttatcaagacatatttttcatatacactctgattcttttaaaccttctcattaccaaacaaataacatattgaaaaaagcatctgttttctattacttattctgccttttctgtgtaggtctcctctaaagcttgcactgtccgatcatgtaatatctttttcttcgtcttatcctgttctacataataagaataaatgatatcaatcatgataagaatcggaaactgaggcgagattacatttccatgattcaaatgacgcaaagagggaatcagcaagacttctgtacagaattctttataatcgtctctattattcgcagtaaataaaacagttttcgcccctcgcttttttgcctcttttaacaggaaaatgacttcttctttctgacctccgatactgaatccgaatacaagactgttttcattttgaaatactgcctgcatacgcattaaatctgtatctgtaattgaatctacatctacaccgatacgcataaaacggatttccatttctcttgccgcaagaccagaacttccctttccacatacaattactttcttagttgcatttagataatttccaattctttcgatttgtttttcatccacaagactgtacgagcgatttaataattcttgataagcattcaaaatcatcaatgtattgcctgtcataaattctttcttttcgacaaagctttcttcatactggtaaataaattctctatagccccgatatccacacttctgggcaaatcgtgacagagaagcttctgaaacaaaaagctttgctgccaccgactttgcagaaaaattgattttcttttgattatttataaaaaaatctgcaattgtcttttctaccattgtgaacttattatagtttgattctatgaccggaataactgacttaatataatattccatctcttacttttcaatcgcttctacaaaagattttgtgataagctgtggtcttgtgataatcgaaccaacgacaacactgtatgcacccagttccagtactcttctggctttttctggtgtattaatatttccttctgcaattactttgtgatttactttagaaacaatttctcttaaaatttcaaaatcattttcttcgatcttatctccttcactctgtttcgtatatccgaccattgttgttccaataaaatcaaagcccagttcatctgcgtgaagcgcttcttctatagtagaacaatctgccataaaaagctgttctggatattttttctttacctcatggaaaaattcatccaaagtctttccttctggtcttgtagaaatggttgcatccattgctataatctccggttttactcccattaattcatcgatttccttcatggtaggtgtgatgtaaatctcactatcctcgtaatctctcttcacgataccgataatcggaagatctacctgtgtctgaatctccgcaatatcttccttagtattcgcacggattccactggctccaccaatctttgcggctaatgccattcttcccataataaaaggggaatgtaacggctcgcttggaagtgcctgacaggatacgattaactttccttttaaattttcgattttttcatttatgctcatcatttttcctccattgataaattattactatttaattgattaagaacagacgaatcattgaatagtataagcctttttgaaatcattttcaatttttttctttcttttgaaagtacttttaaattaaacgtcttttttgtgtctcttttcaacaaaatctgaaagtagctcccgtatccttctattctattgatttttacttttttccgggtatactaaaggcacgaagagacaaaaacaaaaataatttatggtaaagaagcgattacggtttttgttttcttatatctgaataaatagataagatgccagtaaacatttcttttgtactatgtactttaaaataatcactgactggcggaataaaatataaaagtgaggtatatattatgagaatttacaaagcaaccgattataacgatatgagtagaaaagctgcaaacattatttccgcacagattattatgaaaccagactgtgttcttggtttagctactggttcttctccagtaggaacttacaaacagttaatcgaatggtacaataaaaatgatcttgatttttctgaagtaacaagtatcaatcttgatgaatataaaggattaagcccggaagatccacagagttaccgctacttcatgaacacacatttatttgatcatgtaaatattgataaaaatcgtactttcgttccagatggacttgcaactgacccagaaaaagcttgtgcagagtacaatgcaaacattattaaacagggtggtattgacttacagcttcttggaatcggaagaaacggacatattggttttaatgaaccaggtacagtatttaagaaagaaacgcactgtgtagatcttacagaaagtacaatcgaagctaataaacgtttctttgcctctgaagcagacgttcctcgtcaggcatattctcttggaattaagaatattatgcaggccagaaaaattcttgttatcgtaagcggaaaagataaggcagatgctttatacaatgctgttcatggagaaatcactccagcagttccagcttctattctgcagcttcataatgatgtgacaatcgttgcggatgcagatgcattaaataacttctgatttgtagagtttgaaaaataaacagacgaaccctcctcccctgtaatctataaaaatgcttcgtttcactgcgtccaagctgctcatccgcaacttgaacttgctctaaggcgcatttttatagattacaggggaggagggttctgtgtatttcagtcctacaaatcagttgaaaaaaatctgggaatggggacagaagaaataggaattctgattttgtaccagcatccacagtcagcccacaaagagaacctatcccctatatttgtggcctcggagcaaggtttggatacgagcgcgtgtaagcgagtattcaaaccgccgcgactaaagtcacaaatataggggataggctctctttgcgggcgtctgtttcgctctacaaatcaggatttaatttaaagcaaaatctccatcgaagtaattaattttcattgcctcgcggacatcattcaatgtctctgctgctttcttttcagcaacttcagaaccagcctgtaagatatcataaacatctggaatacgctgttcccacatctttcttctctcacgaatcggtccaagttccgcttctaatactttgttcaagaacttcttcaccttaacatcaccaagtccacctctctgataatgttcttttaattcatcaaggttctggtaatccggaagaaattctgcgaagtattcatctttacagaacgcatctaaataaatgaatacaggattaccttctaccttacctgggtcctgtacacgaagatggtttggatcggtaaacatggacataacttttttctttactacatctgcctcatcagaaagataaatacagtttccaagagatttactcatcttagcctttccatcaataccaggaagacgaagacaagctttgttagatggaagaacaatctgtggatctgttaaagtctcaccgtaaacactgttaaacttatgaacaatttccttacactgctcaatcatcggcatctggtcttctcctactggaactgttgttgcgcggaacgcagtgatatctgctgcctgactgattggataacagaagaatcctacaggaatactcgcctcaaagtttctcattttaatctcagacttaacggttggatttctctgcacacgggcaactgtaacaaggttcatataataaaatgtaagttccgtaagttctggaaccattgactgaatgaaaatggttgacttttccgggtcaattccacatgctaagtagtctaatgctacctgaataatgttctgacgtactttttccggatgctctgcattatcagtaagtgcctgtgcatctgcaatcataatataaatctcatcatagtctccagagttctgtaatctgactctctctgataatgaacctacatagtgtcctacatgaagacggcccgttggacggtcaccagttaaaattacttttttcattctttatctatttctccttaatatatttttcgcttttcctaccaagatattatataacccaattcaaaaagcgtcaaccgttccgccctttttctttcatgtttctttcgttaaagaaatgtgactttaagacactattatccatcaagaaatcatcctaaaataaataaaaggaacaattcccacataaccccgaggaaatggagcgtggtattatgaaaaaataaaataaagaggcagttccgtttttttcctgggtttcgctcgctaacagctcgaaaaatcaggtggagaagatttgaagaataagacagaggggattgaatatccagaaaatgaaattctgactttgctccagcagccaaaaaacaacttccaaagagggatactattctatatctgtgactctatcttcgcagtgatagagtcacagatatagaatagtatctctctttggaagtggctcctttgcctgcggcaaatcaaaaattatctttttggttttgccgtaatgcttacccagtctttcatatgattaatttcaagaatttcaaaattatttgccagcattgcttcctttacagcttcttccattgtgttgatgattccggaagtgataaagataccatcttcttttaataatggagttacaattccagaaagtggaataataacatccgcaaggatattggcaactactacatcgtaacgttttccattatttttctcatagaaacggtatgcctcgtcctgatcaaggatatttacctgctgtacttctgcctggcctgcaacaccattgattgcaaagttctcatctgtcgcacgaatcgcatttggatcaatatctgttgccatcgcatgatgtgcgcctaattttaatccaatgatagaaaggattccgcttcctgttccaacatcaaggagttctgtatctttcttgatatactttttaagctgagaaatacaaagctttgttgtctcatgagaaccgcttccaaatgcagtacccgggtcaatctctacaacgatatcatcatcttttttatcagtaagcgtctcccaggttggcttaatcacgatattatcatcaagacggaatggtttaaagaataccttccagttattaatccagtcctcttcttccgttacgccaagcgtaatctcgccgcttcccaccggcaaaaatgctgataactcttcaatcttagcctttaccttcgcaattaccgcctgtaaatcttccttttcatccacatagcaggaaatacgagcctttccatcatctggtgcgatttcgtctggaagaaggtctacatacataatctttctgtcttcctcagataacggcacatgatcctcaatctcaacaccttccattcccatctcggaaagttcatagcttaacatatcttctgctgcagttgttgtttcaatagtgagtttattccacttcataagctttcctcctacttcttaaagaaaccttttttcttatgtttttcgtgcttttcgtgcggagcttcttctttcttttcggaaggggcaacttctcccattgcttcctggaatttgcggagggcttctttctgggctgcgttcagtttttctggaacctgaacaacaaacttgacgatatgtgttccacggatgtttttatttctaagggtaggaacaccttttcctttcagacggatggttgtatctgtctgtgttcctggttttaaagtgtactcgtaaggaccatctacggtgtcaatcttaatcgttccaccaagtgctgcctgtgcaaatgtaaccggttctgtagagtagatatcgtattcctgtctctggaacttcggatgacgggatacagttacgttaacaagtaagtctcctcttgggccgccgttgatacctggctcacctttttcacggattcttacactctggccgttgtcgatacctgctggaatcggcactttgattctcttacgaactttgatgtatcctgtaccagaacaatcagtacatttattacggataatctgaccgcttccgttacagtctggacaagtctggacgttacgaaccgttccaaacatggactgctgtgtgaatacaacctgaccggttcctttacattttggacaggtttctggacttgttcctggttttgctccgcttccgttacaagtcttacattcttcttttaaagtaatctctaattctttttctacaccacggatggcatcatcaaatgtgatacggacaccggcacgaaggtttgcaccctgtcttggaccatttcttctggcatcgccgcctcttctgccaccgccgaagaaatcaccaaaaatatctccaaagatatctcccatatctccgccgaaatcgaatccgccaaagccgccagctccaccgccgccctgttcaaaggctgcgtgaccgaactggtcatatttacttttcttttccgggtcactaagtacttcataagcttcggctgcttctttaaacttttcctctgcctctttatctccaggattcatatctggatggtacttctttgcaacctttcgatatgcacgcttaatctccgcctctgacgcattcttatctacgcccaagacttcataataatctcttttttctgccattttttcctccagcctgatgtactctatcattcataaaacaaaagtactacgaatgatacaatataccagggacttcctaataaacaaatttcccctttctcccccacctgctaaaggtgagggtaagaaagaggaatatttagattttaaacagtgtcaataaacacgctttattagtctacacttctttgtagtctgcgtcaactacatcatctgaattataagttgcatttggatcagcaccggcaccagcctgtggtccaggacctgcctgacctgctgctccgccagcctgctcatacatcttagcaaataaggactgtgcatctttcattaactgctctttaccttcgttaagagctgctacatctgcttcagaaatgttatctggagttgtacggtcaaggacttcttttaatttagcgatgtctgcctcaacagtagctttttcagaagcatcaatcttatctcctgcttcttccatagctttctctgtctggaataccatgttgtctgcatcgtttcttgcatcaatgccttcttttctcttcttatcctgagcttcgtattctgcagcttcttttacagctttatcaatatcttcatcagacatattagatcctgctgtaattgtgatgtgctgttcttttcctgttcctaagtcttttgcagatacatttacaataccgtttgcatcaatatcgaatgttacttcaatctgaggtacacctcttcttgctggtgggataccatctaagcggaactgtccaagagtcttgttatctcttgcgaactgtctctcaccctgtacaacgtggatatcaacggctgtctgattatcctctgccgtggagaagatctggctcttctttgtagggattgttgtgttacgctcgattaacttcgtagcaacaccacccattgtttcgatagataaggataatggagttacatcaagaaggaggatgtcaccggcacctgcatcacctgctaacttaccaccctggatagaagcaccgattgctacacattcatctgggttgattcccttgaatggctctttacctgttaactgttttactttatcctgtacagcagggattcttgtagaaccaccaactaataatactttacttaactcagaagcgttaagacctgcatcgtttaatgctttagaaacaggtgttgctgttctttctactaaatgagctgttaattcgttgaatttcgctcttgttaagttcatttcaaaatgttttggtccctcagcagttgctgtgatgaaaggaagattgatgtttgttgttgtagaggaagaaagctctttctttgctttttcagcagcttctttaaatctctgcattgccatcttatctgtagataaatctacaccttcttttgctttgaaatcatctaacatatactgtgtgattacgttatcgaaatcatctccacctaaacggttatctccggctgtggataatacttcgatgacaccgtcaccaatctcgatgatagatacatcaaatgtaccaccacctaagtcatataccatgattctctgctcattctcgttatcaagaccataggaaagagctgctgctgtaggctcattaatgatacgctttacgtcaagacctgcaatcttaccagcatcttttgttgcctgtctctgagcatcgttgaagtatgctggaacagtgataactgcttctgttactttctcacctaagtagttctctgcatcagattttaacttctgtaaaatcattgcggaaatctcctgtggagaatactttttatcatcaattgttactttataatctgtacccatttcacgtttgattgatgaaatagtcttgtcagcatttgttactgcctgacgctttgccggctcaccgacaactctttcaccagtctttgtgaaagctactacggaaggagttgttctcattccttctgcatttgtgataacaacaggttttccaccttccattactgctacacatgagtttgttgtacctaaatcaataccgattattttacccataattatttcctcctgtattctgtcaaattcgtatatctaaaatatgactaattaactacttttaccatgctgtgacgaagaactccatctttgtacatatatcctttctggaattcttcggatacaaggttctcacccatctcttcattctcttcatgcattactgcattatgaaaatccggattaaattcctttcctacagcatccatcggttttacaccgatttcttcaagtacggtaatcatctgctgataaattttgataaatccctgagcaaatgccccttccttctcttcttctgaaagagcatccaaacctctttcaaaattatcaacaaccggaagtaactttgcaagaacctctttcgctcctacatcatacatatggctctgctcttttgcatttctctttctggcattctcaaattctgccatcagacgctgatatttatctgtcatctctgctgctttttcttcactcttttttaattcgatttcaagagcggctgcagacttctttttctttttcgtcttggtttcttttgtttcttgagtttccgttccttcctccgtcgttgtttcttctggagtctctcccttcgcctcttctacgatactttcgtcggatactttcttttcttcttccacttaagtaccacctttctatgatttattattaaaaatctcatctaaatcatcggttagatttctgagagtatttacaacctttcggtaatccattcgtttgggaccgataattccgaccgttcctgttccgccttccttcaattcgtaagtggcagttacgatactgcaatcccttaaagactgtacctgcgtctcattaccaatgtaaacctgtataccatgcttctcttcctgattcaccgtatcatcgacaagctttacaagctgcttcttctcaactaatgtgtcaagaagtgctgtcgtatgctctggattggaaagttcaggatacttgagcatattggttgctccgctggtataaatctctaaattatctgcttcgtgaattgcctctacaatcccattaaaaactccttctaaaatgtctgcatgcattcctgcctgcaccttcatcgtgtgaactaactcaatgttaatatcattcagtgttagtccctgaaggaaagagttcaacaaaatgttaagctttagaatctcgtcattgccaagaggttcatccatattcatgagcacgttcttaaccgtatcattgccaaccacgataacgaccagaagtcttcgtgaatccaccatagaaagttgaataaacttaagctttgactccttaatctgtggtgcggaaatcaatgtagcatagttcgtatttgctgcaagaacatctgcgacattcttaagaacctcctccatgcgatccatcttattaatcaaatcctgatgttccttctccctctcggtctcccgtgttcgaatttcatcattctcttccataagacagtttacatagtaacgatagcctaaatctgaaggaatccttccggcagaagtatgtggctggaggatataaccaagctcttcaagatccgccatctcattacgaatcgttgctgaacttaaatgtaaatcagaatctttggcaatcgttctgcttccgaccggatctccagtctctaagtaagtagatataattgcttttaaaattttcatcttacgttcatccagttccatctcttactcccttccttcttagttattagcactcatcaatattgagtgctaatatctacattcattaagttatcactatcttcaatccttgtcaagtatattttaaaatttttcctgaacttttttttacagagcgtacagattgccagaatgatttttcaaacactttctaaattcctttacagcataaaatcacagaaaatgtaatcactcacatcaatccctgcatccgtaagccgaagcattttcccatcagctgtccattccaataaatccatttcttcatatttagcaataacttttccatatatatctttaagacccaccctaaagcgctctttaaactctctctctgaaattcctgctctttttctcagtcccagaaacataaactcttctatctcatctttttcgcttaacacagtataatcttcccgcatcataaatggaacatacggctttttctgatattcttctaaattcttctcattagaaaaacgagtcccttcaaaataagaagaagcaccaagtccaaatccaagatacggtattccactccaatatccaagattatgaatacattcttttccctttctcgcataatttgaaatctcataccgctcgtagccattctctgctaaaacctctttcgtgagctgatacatttccctgtctgtctcttcatcaggaatcttcttctgaatctcctccgattcaccaaacggtgttccttcctccaaaatgagactgtaggcagaaatatgttctggctgcaatgccatcaccttttccagcgtccttctatagatacttaccgtctgccccggcagtccactcatcaaatctacattaatattctcaaaccccgcttttctcgccagctcataactcttcaaaaattcttcccatgtatgaattcttcccaataaatgaagacaggcgtcatctgcactctgtaaccccatactgaaacgattcactcctgcttttttataagaaaaaacattctccttcgtaagcgttcccggattcgtctccattgtaatttctgcttcttccattataaaaaatgcattccgtaccgccagcataatcctctctatctgctttccggaaagaagcgacggtgtaccgcctcctataaagatacttcgcactgcatatgcgtctttatctaaaagtttacctgtctgctctatttcatttatcaaagactgtacataaatctcccgtctctcctcatttgaagggaatgaaagaaaatcacagtagttacacttttttatgcaaaatggaatgtgaatatataattccaaatcggttttgcttgcacacataatttttcctttctatcctgatttgtagagcgaaacagacgccagcaaagagagcctattccctatatttgtgactttagtcgcggcagtttgaatactcgctttatatgctcgtatccaaaccttgctccgaggccacaaatatagggaataggctctctttggaagctgtttgctggctgcccatgcaaattcaggatttattttgagaaagatttgagggaggcttcaacaggttgtgactttttgaggaattgaaaaaaatagtgaccataaataactatacgattatggcactgattcaagtgtcaatcctatagaatttcatttcccagaactttacatttcctgtcctcttccccaaatctctccaactgattttctgagctgccaacgcatagaactcctgaagctaaataaagcatatttgtggcctcggagcaaagtttggatgtgagtgctgtaagcgaacattcaaaccgccgcgactaaagtcacaaatatgctttatttagcttcaggagttcgtctgctttgcagcctcacaaatcagaatttagtcttcatccaatttgagaacgctcataaacgccttctgtggtatctctacgttaccaacctgtcgcattctcttctttccttccttctgtttttcaagaagcttcttcttacgggaaatatcaccgccgtaacatttcgcaagtacgtctttgcgaacagcttttacggtttcacgagcgataatcttgcttccgatggctgcctgaattggaatctcgaataaatgtcttggaatttcttcttttaatttctcacaaatctttcttgcacgttcgtaagctgtggaagaatgcacaatgaaagaaagagcatccacggtctcacggttaataagaatatctaacttcacaaggtcggactgctggtaacctttcatctcatagtcaaaggaggcatagcctctggaacgggattttaaagcatcgaagaagtcgtagataatctcgttaagtggcagttcgtatttaaggagcgctctcgtttcttccatatactccatagaaatataggttccgcggcgttcctgacaaagtgtcatgatagcaccaacatattctttggttaccatgatttccgcggatacgattggttcttccatatattcaatggtggatggatctggaaggtttgtcgggtttgttaagtcaaatactgttccatccgtctggtgtactttgtaaataacactcggtgcagtcgttactaagtcaaggttatattctctttctaatcgttcctgaataatctctaaatgtaaaaggcctaagaatccacaacgaaaaccgaaacctaatgcaaccgaagtttccggctcatactggagtgctgcatcattaagctgtaatttttctaaagcatctcttaaatccggatatttggctccatctgccggatagattccacaaaataccatagagtttacctttttataacctggcaggggttctgcacatggattatcggcatctgtaacggtatcacccacacgggtatcttttacatttttaaggctggctgtaatatatccaaccatgccggcagaaagctcatcacacgggaagaactggcctgcaccaaaggttccaacctcaacaacttctgctttcgcaccagttgccatcatcagcatatttgtaccttttttaatggttccttccatgatacgtgcaaaaatgataactcctttataagaatcatatacactatcgaaaatgagtgcctgtaatggattctccgggcttccacctggtgcaggaatcttttttacaatctgctctaagacctgttcgatattaattccgtttttcgcagaaatctttggcgcatcctgcgcttcgattccgataacatcctctatctcttctacaacacgatccgggtctgcacttggaagatcaatcttgttgataactggcataatctcaaggtcatggtctaatgccaaatatacgtttgcaagtgtctgtgcttcgattccctgtgccgcatccacgacaagtaccgctccctcacaggcagcaagacttcggcttacctcgtagttaaaatcgacgtgacctggtgtatcgattaagttgaatatatactcttctccgtcctcagcatgatatacaatacgtaccgcctgagacttaattgtaattccacgttctctctctaaatccatgttgtcaagaacctggttctgcatctctctatctgtcagcaatcctgtcttttcgataatacggtctgctaaagttgattttccatggtcaatatgtgctataatacaaaaatttcttattttactctggtcaattccagccaaggcagtttcctcctattttataatatgtactctcagaatctttttgtgcttgatctaattctatctgtcctattctatcatgagttctctgcctttgcaattttttattcctgatttgataacttaataaattcatccagtcttgcctttgcttttccactgtcaatgatctcagaggcaagcttcacagcatcttctaaagtatctgcttttcctgcaacatagaaagctgctccggcattcattaaaaccgcttctcttcttggacccttttcaccatttaagattgacagggtaatctttgcattttcttccggcgtaccaccgaccaattcttctttatcacatttcttaaatccaaactgttctggttcaatctcataagaacggaactttccatctttaatttcacagacacttgtcctggcactcatggaaatctcatcaagacaatcctgtccgtatacaaccattgcattttttactccaagattggaaagtactcttgcgagaggttctaccagtttttcatcatacacgcccataacctgcatattggcaccagccggattggaaagtgggcctaaaatattaaatacagtacggattcctaattcttttcgtacatttgccacatagcgcatcgctgtgtggtatttctgtgcaaaaaggaaacagatattgatatcttttaacatctgtgcgctttgtgctggtgaaacggtaatatttactccaagtgcctctaacacatctgccgcaccacatttactggaagccgctctgtttccatgctttgcaaccggaactcctccagcggaaatgacaagtgcagaagttgtagaaatattaaaggaattagaacgatctccaccggttcctacaatttctaacacatccatatcattaagaagtcttgtacaatgctctctcattcctgctgcagaagcagtaatctcgtcaattgtctcacctttcatggcaagtgcagtaagataggcacttttttgaatatcatttgcctcgccgctcataatctcgtccatgacagcctgtgccatctcataacttaaatcttcttttttgcttaatttgataattgcttctttaatcataacttatgcctccatctttgtactttcgttgttgtcatgtggattctttttgatggaattaatgtaggaaatgcgaaactatttcataagaatatatcctgtgaaataaaaaacccgtccatgacaacgtattactactttgtcaaggacgggtgtattatcaaaatgttattctttcacatccgcggtgccaccttgattcacaaaatgtgcgctctgaaggataccatcatatccctggcaactgacgtatgccctcacgtcacagtgtactaaattcctgaaactttctgaatcttgttctaaatcctatatgttaaagaagattcctgttagttaacaaaaactttcataaaacctttgactgtgccctccacggtccatttaataatctgcgtttaacccggctctcacctgcccggactctctgtatatgcacaactatttttatctccgcttcaacggtttgatttgaaaaatcaaattttctgatattattaaaacataaaccttatcgtttgtcaatttattttttgtaattgcaaattatctgttcaaaattctatacagcacagtctcgtgttcaaaaaagaaacaacaaaaatataattttacttgtagttctacatatatttttaattctttttataagatttttccccagataagagccgatatagcatctcagctaatggtttcattgcatttttcgcttcctccactgtattgttctgtgctcctacctccacaagcatcgctctttttgccaaatgaaggttataacgatagccttttatatagattcttcgtgtcagatctggataatattttccacataaaagctgcatctgcaggctgaatgccagatttgcctccttgtttggattataaagataaccgatatcccccttacttgcaaggcggctgactccattaaaaaacataatctgtgctgcagactttccattgatttttgtgcgaaggtgtatattattttctacagaatccctgtgcaggtcaatcactacttttaccgaaggatttttcctaagtgccgcctccacactatcacctgcaaagttataagcggcattgcggtcaagctgtccgtctaccatatcataaacagatttgtcatgtaccgtttttattccgtagacattttccagttcttttgtcagagcagttcctacttcaatcacagaaccttcttttccatttacctttttgtacgtttcacttccgtgtgtatggtaaataagaaccagtggctcctcctttcctaattttgcagacaaatccattgtcacaagctttgttccatttaaatcctgttttgtcatagatgttgtctcatccacaatataaaaatgttccagcaaaaaagaataacttgccagttcttttattgtataggatcttcccgttcccatctgcttcatttttccaggatcttttttcttttcttctacagactgatcatccgattctgtaaaataatccggcaccgtatcactgtattttgccttatagtactcctttcctttccagtaatcaagcgcaaatctttgaattgggaaaagctcctcctgcattccatttcgaaaaaaaggaaggagcattccctttccccctcgtatgtatcgtatccaagaattggcgtcaattcatactgcccttttcttatactattttcaaagaaatcatgaaacacctccgtgtgcactggaatatattgccataaagagagtgttctccgctttacctttccacttcctcccgataaaaataagccccataacaaaataaaaagaacaaacaataaaccttctattacctttaaatttctctcttgcataatccctcccaagaaaatagcttatagcaattttccaaataacttattagcaaaaacaattcccttttcctgatcacataattgattgcatgattatacaaacgctcaagataattcttataatataagcttatgcctgtcctttttatttatgatttgatttagaaaatcctccctgcaacaaactgattaatcccttccgaaagcgtgtaactaattcgctttactgcctcatcaatttccttcggtgtcacaaaaagttcccataacttttcatctaaaatttcccctaaaaaatgatacttttccttttccggccacgaacaaaagatatcttccattccctcgccctgagaagcacaaaaagcttccataatatcacaagccaatgacgggatggaaattacggttggaacacctatcgcaatcactggaatccccatcgttttttccgtaatctcattccgatgatttccaacacccgaccctggcgcaattcccgtattactaatctgtattgtcctgttaagcctttccgaactcttcgccgctaacgcatcaatcactaccagcgcatctgggtgaatctttttcacaatcccctcaacaatctcccctgtttccattcctgtctgtgccataactcccggtgcaagtgcggcaaccgccggacatccctctatctctttccatccagtcagatgtcttgttataaaaaggtttttaatcacaagcggaccaagggcatccggggtcacctccccatttccaagtccaataaataaaagctttctttttcctgaaagcagggactgcagccgctttgcaagacattcgctcatttcctcatgaaagcttccatcattccctgccatattttccccttcaagtgtcacatagattccccgtggttttccaagctgtttctccccctcctcactgtcaatctcaatcactgtttcctgcagtccccgctctccgatacgctcctgctgaattttgattccgtcaaaggcctgctgctcttctagggattcttcaagctcgtcttttagttccaatgctaagtctgtatgagaaaaagaacgttgtatattcataagagtccctcccttttcattatcatcaagtattatgttacaaaaataactttaatatacatagccatactaattttaatatatctaaaaaattttttccttaaaaattttcattttccacttgacaaatagcccaaaaatcaataaaatataatagtatgtttacattagattgtccgtgtccgaaataatgcaaaacaatataaacataaaaattataagtaataatatttggaggtgtacagattggctaacatcaaatctgcaaaaaaaagaattttagttatcgaaacaaagacattaaggaacaaatctattaaatctaaagtaaaaacttgtatcaagaacgtagaagttgctgtagcaaagggtgacaaagaagctgcacaggctgctttaacagttgctatttctgaaatcagcaaagctacttctaaaggaattttccataagaacacagcagcaagaaaagtttcccgtcttacaaaagcggttaacggaattgcttaattagaataaaacgtttatctccgaaaagagcggctgcttttcggagattttttgttttaggtaaaccagacgaacaaaagccctcccatactccctatttatgactttagtcgcggcgtgttgaatgttcgcttaaatgcgctcgcatccaacacttgctccgaggtcacaaatagggagtataggagggcttttgttctgtctttggctgcctatataaaataaaaatctctcgttgggggatttggggattctccagggggatgtgatttttcaaaagaactatgctaactgcataatatgttacaaagtggagagtaattttgctaaaattacaattcctaaattctgagttgctgcagcagccaaagtcagcccgcaaagagaggctatcccctatatttgtggcctcggagcaaggtttggatgtgagcggttaagcgaacattcaaaccgccgcgactaaagtcacaaatataggggatagcctctctttgcgggtgtctcctgcctgcggcagctcaggattaaagcattagtctgcaaatcaaactctccactcctatttgatcattaattcgtccggtttttatttcttcttctatctggatgcattcttcgatgcatttttccaacattttttctccatatcccctaagctgctgttcatttttgcgaatggcaaagcgtgggattccggcggttttagcaatggcatcgtccggtttgcggagtcctcgcatgttagcaatgatatgcaggattcggtactggcgtacaattaaaaataaaatgtgcattgggggttcttttagaagaatgaggtcattgtaataactaagagctgctgccttatttttacgggcgatggcatctactaagtcaaaaatcttgtcctgtacttctccagaagccacggcatcaatgtctgcctgggtgatttcctcgcggtctccagcgtaggcaatgagtttatcaatctcattttttatctgaaacatatcatctcctgttttttgcaggaaatatcgggcattattctcacgtatctgcttcttttctttgccaagtaaagcagcaatccagcggagaagaactttttctgtctgatttttctttaaaaattctccaacataaccattcttttttatccatttatacacttttgaacgcttatctacttctggctcacagataataatacaagttgtctccggcatattttccataatgcttacaaattcgtcttttcctgtttttaggattcctgttccgtccaaaagaagaagtcgcttctcactgaaaaacggataggtaaatgcaagttcctgcaaagtatttaaatctattttaccgtctgtaaaagcggcatagttcatcgtatctccttcttttatcatcgcatttttcagcatatgttttgcctgaaggacaagatacggctcatctcctgtcagaagataaactttatgaaaagacttttcttttatctgttttgttagttctttcatgatacactctccgattctatgtgtgattattaaagcaggaaactgcttgcatacacagctataaataattatcctcttttaaaataatttattttatatttctggccatcactttcgattataattgctccaccccacagtgttccataaatatccgctccatttttctgaagtttctttattgtctccttatgcggatgtccatatagattattctttccggcagatataatcgccttttgcggctggaattcttccaagaaactttttgttgtagaatttttagagccatgatgtgccacttttaaaatatttacactcggcatgctttcttctcctctgtctggctctaatagagattcctgttctccatttaaatctcctgtaaataacatggtaaatttatcataagtaagatacaataccagagaaccactattggtatcttctgcctcccatcccttttggggatgcagacagcgcagatgaattgtaccaaaattcagttgatctgctctgcttatttttaagaaggaatatccttttttcttcccagcctttcgtatagtgttactgctattcatagcttttgtatctggcaaaacgatatgctttattggataattctgctcaaacaactctcttattccagaaatatgatcttcatctgtatgagttattataacatagtctaaatggtctgtcccatagtatttaagtgccggtaccagcgtatactccgcaatatttttcttagaagtactgccaccatcaatcaacatactttctcctgttggcatttttatgaaaatacattctccctgtcccacgtcaagcattgtgatcttaagagctggtacagtgaaaaaacatcttcctgctatcaggaaaagacaaaaaatcacactgaaacccttctgacgataataccataaaaagaaaaaactaatctcaatgaaatacaaaaacagaatttcccaccagggagggcatcctgttacaatcacagcccctggaatctgcttcaccaatcgaaaaatcatctcaaaagtccgcagcaatactaccgcaggaatgcatcctaaaaaagccgacacatagctaaaaaagccaagcagccctcctaaaactgcgctaatcaatagcggactcattgccggaataacaaacatattcagcaaaatactataaggactccactgataaaaaaagcgtagtaacaaaggagttatactcatagaaatgacgatatttgcaaaaaaggcctgccggattattttccttctgggactctctgtaggaaattcccctgctacaagtctgttttggctgcgcttttcccaaagttcttttgcaataggcaaaattatcccgatagaaaatatggatgcaaaagaaatcacacatccgctttctaaaagtctccaggggtgttccagcaacattagtattcccgccaggctcattgaagaaatcatatcatattctgcaccaaaatattgtgccagcaaaaagcaaaaaaacatgactgcagctcggaaaacggaattgccaaatcccgtcataaccgcataaaaaaacaaaatcccacttccaaccatgcaggaaaatgcataactgcggcccttttttctaagaaaccgaaacaacattcccccaacgatagaaacgtgaagaccggaaacagctaagagatgcgccatgccattttcttcatacaaatgtttctgttcctttgaaagatctgtcttatccccaagaaatatcgcttttaacaatgcatattctgtatcagataggatatgtctgtatatcgcatctatcttttctctgacgttccctgctattcgatgcaaagacaacgggctttctctctttcttgtaagattttctccaaaaaactgataacggatacctacagaataataatatatttttgtattaaattctcctggatttatctgttcttctattgcttttaactttcctgtacaagtaataaaatctcctgggtaaatctttccttttgatacgggaatctttacaaggcgacattttcccggcagtttttttgtttgtctcaaattgctttttatactacttatactacattttttcaaattcttttttattttgtcttttaaatagctttcatttactacaaaagaattctccctcactgtaatctggtactccccttcagcattctgtctgacatattccacctgcccaatcagagtgccggtcaatgtttttttagaaagtatccggtcaatctcattaaaatagctggctctaaaaaacgcaatacctcccataagaaaaaagaaccagcacaacacttcatatatgaagaaaaggctctgttcccttctgacttttcgataaaatataaaacaaaatatcataaaaatcaaaagaaacaaagccatcacaaaaaaaccgattctgtctaaaaaaatggctgctgcctctccaagcacgagtcctataaaaaacagaaataatggtcttctcacttattctcctttattcagttatttacacaaagaaaaatcacttgtcagtaatgcatcaaaattctcaaactcatttaatttgcttatcttttttccatcaatcgtaaactgtacctgatatgcagtatctaaatctgtaagactgtttaccatcgcataaacggtgaccttttcctttacattcactgctgccttttccacctcactactcaagtcgacatagcagatgttattaagaatttgcgtctgattcacataaaaatctgatggaagcgggctctttaaattcttttttgaagcaggcggattctttaaagcaagcaaaacctgggtctctaacggaacattatctgttactgtaagttctgttaaatacggaatcaacttgtctcctgtttcattcgtataatacatctttactttctttttagcggaataaatatctgcctgaccatcatcagtcaaaattgtagaggcctccatcagccccacaggcattttgtcattgtctaaaagactcgaaccattcacagaaaacagtaccccatcaatgccttgaatctgaagcagcgactttacaaccgatgttctaagcagcacttcctgcgtatgggacagttgaatgtaaccagctccaaaatcaatcgttgcctttcctctgctgacactaacatcattaataacaactccgtcaaaaatagatgccttatacttattggtattattattctctgtatcagaaagtttatagagtacttcattcgccatttctttcagatcatccgaatgctgcagcttgcatgaaaccttcttaaagccatcttcctgtgcatttaggtagtataaatttatcgtattgttctttttcctgtctgtctcttctttcgtaacctgttcctgattctctgttttttcctgcttttcctgcgcagactttgtacttttatcacagccacataaaacagtaaggcttagcagacttacaagaaagataacataaggtattctctttttcatagcatctgcctcctaactaatgtaattcagaggaatacggataataaaggtggctccttctccctctttactgtgaacacgaatcgaacctttatgcattagcacaacattccttgtgatagccaatccaagaccagttcctccggtctctcttgaacgcgccttatccacacgatagaaacgctcaaaaatctgttcctggcaatcctctggtattccgcatccagtatcctttacacgaatatagaaaaacttgtggtctgcattcaaagatacatctaccttaccgtcatcatgattatacttcactgcattctcaatcaggttgttacaggcaagagaaagctttacttcatctacttctgctacaacttctctcatcgtttccaaacgaatcttaatacctctcttctctgcgattggagaaatcctcttcaataatacttctaacaagtcattgatttttacagaagtaatatttaaatctgcctgtgtcttgtccatcttcactaaagtgagcaaatccgtaataatctgattctcacgatcaatttcatggacaatatcattcataaactcttcataaagctcaacagggacatccggctgcataagcagggagtctgccagaatcttcatggaagtaatcggcgtctttaactcatgagatacattagagacgaattcctgtcttgtattctctaactctttataacgattgataatcttgttaaaagaggaagataaattataaaattctctgaaattctcctgtccaagcccctcctcctgatgtcctgccgcaataatatcaagctcattctgcattcttctgaaattattgcggataagtaaggcaacaagcacactaaatatcaacgttataataaaaaatataccgacaagattatctctctgatcataaagatattcggacatctcattacagttttgtaacgaaaccatcgcaatgatcagtcctcttacatcagacttatcattatttttatcttgaataggtgtaataacctgaagatattgctttcctatataacgataagcaacctcttctcccttcatcgcatgaattgtctcttttgtcacaagatacttcccacaatttcggttatatgtatctgcaagtatcttaaaacgactgtctacaagcaaaatacgaccctctaaattattggcaagctgttctacttcaaagacattttcacctgcttcatccgaaaggctgctcatattatagttgcgaaatccgttcattactatttgatcagaaagtacggcacattgtttttgtgtgtaccgcactctttgatcaatcgcttttttttcataataattgatctgactggaaactcccaccaccaaaaaaacattaatcagaaggaacgtaaatacaccaactacctgatataatgaaatgtaatgggaaattccttttatattaatcttggaaatagtatcctaccccccactttgtatgaatataaagaggctcacctggattcttttcaattttttcacgaagtctccggatatgtacatctactgtacgaacatctcctggataatcatatccccatacaatattgagcagattttctctgctgtatactttatttggatggaaagaaagaagctcaagcaaatcatattccttagccgtaagttttacttccttatcttctacaaatactcttctgctgtcacagtctatcttaagcccattcttctcaaatatttttttcttctcatcttctgtcgctctcttagaacttctgcgcatgatggccttgattctggcttttacttctaaaatattaaatggctttgtaatatagtcatctgcaccatactctaatccgagaatcttatccatgtcatcaccctttgccgtgagcatgatgattggcatattggaaaactcccgaatcctctgacaaacttcaaaaccatccatctttggaagcattacgtcaagcagaacaatatcatattctgtctttttggccatttcaagggcttcttccccatcataagcacagtcaacttccatatcatcctgtacaagagaaaacttaattccctttacaatcagacgttcatcatcgacaaccagcactttttttcccataacacacctcagttaactgtaattaaatcttttattcgattaaaaatgccatcacctatccctgcggcatctttaattccttctatggaagtaaaggaacccttttcttcccggcatgcaataaccgcatctgctcttgactctccaatacctggcagggtcattagttcctcttttgatgccgtattgatatttaccgtatcttctttctgggaagctgacaaatcttttcctaaagactgctcttcattgagcgcttccttcgcctcatctttagaagggatgtacacttgcattccatcctgaagaacttctgccaaattccatgctgtctgattcgctttctctgaaaaacctccggcggcatcaatcgcctcctgcgttcttgcaccgaaatgtaaacgatatacccctggcttcttcacacatccacaaacgtgaacataaatttctgtctctcttgcctgctctgtgtcctctttctgatccgcctttatcactacagtagaatctgtactttcttcctctcttaccggaacagaaaaagaacatcctgccaaaataatcattacgattccaagtgctacgctaatcaaccttctcattacacactgtctcaaaccaggtactctcctccttatcgaaacagtttcggaataactttatactccgcagaaaatgttgcctttgcatatagtccatagtcttattaataataccgaatatctaaaaaaaacacaagagggtaagacgattttcttttaccctctggctttgaaaataaatatacctgcaagaaataatccagttcctaacaatttcatccagtcaagccctgttttttccactccaaaaataccaaacacttcaataaggtaggctacaataagctgcgctgctacaattagcataactgcctttgccggtccaagtgtggacatccctgcaattacagtaaaggtaataaatgccccaataactccgcctagtaaataatatttaggttccactgcgaaaatctccatcggaggatgtttttttctttctttaaaaaaccagataacaaggcaaagaagaaatcctgtaaactgcacaaaagaattggtcagccatgttcctgtctgtttcgtcacctctgtattaaaaaccccctgaatgctcatcagggcaccggaaactaatgctacaataaatccaaacataaaaaacctccatacgcttctctttattctaatttttaatgtacttctaaaatcttctcacaaaattaagtacaaaagatttcgaggctgcattctgttaatatagagattagtatggaggttctttttatttttatactgtttttatcgtatttactatatgaaaccaatcacttccaaacaagccatcaaaccacagtaaaatatacttaatggctcatccttatattctgctttctgccatataatttttcagacatttacaagtatggctgcataattttactgaagtccgttctctttcattgcctctgtaaggatagcaatcatttcatccacatctttcttctcaataacaagtggtggaacaaaacgaatgatattggctcctgctgaaatgataacaagaccttttttcagtgctgtaacaatcagatcaccaactggtccttcaaattcaagtccctgcattaagccaacgccacgatggtcttttactgtggcaaactgattctttacttcctcaagcttttcgtataagtatgtacccacttcattcacatgagccacaatatctttttcctcaaactgacggaacacttcacatacggctgctgttgcaaatgggttaccaccgtaagttgttccatgatcccctggaactaatgcgtgagaagccttttcatttgtcacaaatgcgccaactggaacaccacagccaagtgcctttgctaatgccattacatctggttttactccgtaaagatcatgtgcatataaagatccgcatcttcccataccacactgtacttcgtcaaagatgagcaggatatctttctcatcacaaagctttctaagtccttctaagaactctttctttgccggatagattccgccctcaccctgtacaacttcgcagataataccacaggtcttgtctgtgattttagattttacatcttcaagatcattaaaatctgcaaatacggcacgcatctctactggaacaaaaccatcttgatagtgtgcattaccagtcacagataacgctccctgacttcttccgtggaaagaatggttcatggcgataaattcataatcttttgaagaatcctttaagtaagcatattttcttgctacttttaatgctccttcaatcgcctctgttccactgtttgtaaagaatacttttgacattccagaagtctttacgattttctctgccgcatcaatcgctggctgattataatacagattggaagtatgtaaaatcttatcaatctgattttttaacgcatcattatactctttattattataccctaatgcaaatacggcgatacctgctgcaaagtcaaggtatctttttccatccatgtcataaaggctgactccgtcacctttttcaaatacgactggataacgattataagtctttaaaatataatcttctcccttttgcatgtattcctgcatttttgtcatttttcttcactccttgcttcgttaactacaaacttcaactttcaagaatgtccggcattcttgctgctatatatgctatctgagtttttcagtgcttgattttgtgagaaaattttcgtcagttgttcataaatttctgaggtgtacgcggaacgtacgttgatgaaattcaggtgaaactggtggaaaattgaccacaaaagtgagtgctgaaaaactcagatagtacagtacctaaaaaagaggttcttttaaaatagcggtaccaatacccttttctgtaaagaactccagaagcagacagtgtgctacacgaccatctaaaatatgtactctggaaacgccctgttcaatcgcatcaatacagttattcagttttggaagcattccgccaccaacaacaccgttttcgataaattcttttgctgtcttaatatccatctcggaaattaatgtctttttgttagcagggtcaataaatactccttcgatatctgtaaggaatacaagcttttctgcatccattgcctttgcaacaccacaggcagcatcatctgcgttgatgttataagcattgaattcatcatcaagaccgatcggagcgattacaggaataaagtcgttgtccattaatgtatttaacaggtctatattaacagaagcaacttctcctacaaatccaatatcttttccatctggcatctttttattgacacgaatcatgtttccgtctttaccacaaagacctacagcattgacacccatcttctgcatcaggccgacaagctctttgtttactttatttaaaaccatctctgcaatgttcattgtctctttatctgtcacacgcagaccgttataaaattctggttcttttccacttaattttacccatttgctgatttcttttcctccaccgtgaacgataatcggacgcataccaaccagcttcagtaatgctacgtctttaataacgttcatctttaactgggcatcgagcatggcacttccaccatactttacaatgatggttgccccgttaaaacggcggatatatggtaacgcttcaatcagcgtattggcttttgtcattatttcatctacattcttgttaatttccatttctgccatatttataattatctcctttattgtcttatgtcttctggaaatctttttgaccctattcttgtaagaagactttttgtcatccaaatttttagttgcacgcgatacatacattaacaaaattcaggagcaagtgacaaaaaaatcagccacaaaagtaaggaggataaagattttgaaaatatagttttctttatgaactatgaacgatagtccgcgttaatcgttacatattcgtaagtaaggtcacagccccatgcagttgccttttcttcaccagcatgaatatcaagaattgcctttactggatttgcggaaagaatctgtgttgccttttcctcgctgtaatccgttgcaataccatcttttacaattgcaaggcttccctcttcactttctaatacaatatctactttttccggatcaaatgttactccgctgtatcccatcgcacaaaggattcttccccagttggcatcctttccaaatacggctgcctttgttaaagtagaacatacaacagacttactgataatctttgcatcttcctttgtagctgctccattacaggtaacttcaaaaagacgagtacatccctcaccatctcctgcaatctgttttgccagatattccataacgtaagcgagggctgccttaaattccttaccgtcctcatcctcttctgtaataacagggttttctgccagaccgttacaaagaacaagacaggtgtcattggtagaagtatctccatctacagaaatcatattaaaggtatcttctacgatttcacttaagaactgctgtaaaagcttctggtcaattgccgcatcacttgtaataaaggaaagcattgttcccatatttggatgaatcataccggcacctttacacataccaccgattgttactgttttgccacctaaagtacattctacagcaatttcttttttatgagtatctgttgtcatgatggctgttgctgcattctcacccgcttcttttcctgaatcaagttctggaactaacatctcaattcccttttccacaacatccattacaagctgtgctccgattactccggtagaagcaacaagtacatgttctggagcaatactaagaagttctcctgccttttctgcctcttttttacaattagaaagaccttcttctcctgtacaggcattagcgatgccactgtttacaacaactgcctgtgcctttccttctttatatacaacatctttatcccagaaaaccggtgctgcttttacaacattctttgtaaatgttccggcacatacagcttccttttcagaacaaatcattgccatatctttattagtctttcctgccttgattccggcgcgaagacctgctgctttatagccttttgcggcggtaacgccaccttcgattactttcataaacaaacctcctgattcagaatacttctacttttctttatacgattctactttacaattcctacctgcattttgatggtaaatcacataatacttatattatataaatattatttatgggaacacaggaggcattaataatccttctgtctctggtaaaccaaataataagttcatattctgtacagcctgtcctgctgcaccttttacaaggttatccatcgcacccatcataataacacggtgagttctctcgtctacctttacattaacatcaacatagttgctgccctctacccagcgggtttcagggcatacacctgcatttaaaaaacgaacaaactgttcctctttataagcatcctcataaattttacggatttcttcttctgtaacatcttttacaagattggcgtaagcagttactaaaatacctctgttcataggaacaagatgcggtgtaaagttaataaccgcttcctgaccagatgcataggataactgttcctcaatctctggagtgtgacggtgagttgctacgccgtatgccttaatactttcatttacctcacagtaaaggtttgcaacctttgctcctcttccggctccggaagtacctgacttcgcatctacgataacagacttcatatcaataagtcctgcttttgctaatggataaatagacagaaaagaacaagttggataacatccagggtttgcaatcaggcgcgccttcttaatcttctctctgttcacctcacaaagtccgtaaacagcttctttaataaactgtgggctttggtgcttgattccgtaccacttctcatatgtatctacatctttaatacggaagtctgcgcttaaatcaataacctttaccttagataatacattctcgctaactaaggaagaacaaagtccctgtggagttgctgtaaatatcacatcaacttcctcacaaagctgttctaaatcttctcccttgcaaatgtccggcacaagctggaacatattctgaaatacactcgcatatgcctgatctatgtaacttcttgaaccataccacttaatctctacatctttatgtccaagtaaaatgcggacaagttcctgtcccgcataccctgtagaaccgataatacctgctcttatcatttctctcatcctttctgtgctcatctcttattttctatataaatagggatataatttcaattttctattatcccacaaacctttccagaaaacaagagttataatttttcacatatttattcgaaattattcataattatacaatcaaactgcgatttatgcaagtattaattaatatttattaataatattttaaaaaaactcttgcaattccctgtagaatgacgtatagtatatgagacaaatgacgaaaaatttaggaggatatatagaatgagtaaagaaaaagtagttttagcctattcaggtggtcttgacactaccgcaatcatcccttggttaaaagaaacatatgattttgacgtagtatgctgctgcgttgactgtggacagggcgaggagcttgatggattagaagaacgtgccctctactccggtgcttctaaattatatattgaagatatcaccgatgatttctgtgagaactacatcatgccatgtgtacaggcagatgctgtatatgagaacaaataccttcttggaacttccatggctcgtccgggaatcgctgccaagttagtagaagttgcccgtaaagagaacgctgttgctatctgccacggtgctactggtaaaggtaacgaccagattcgtttcgaacttggtatcaaagctttagctcctgacttaaagatcatcgctccatggcgtgatgacaaatggcagatggattctcgtgaagcagagattgaatactgtaaagcacatgatattcaccttccattctctgtagataacagctacagccgcgaccgtaacttatggcatatcagccacgaaggtcttgaacttgaagatcctgcatgtgagccaaactacgaccatttattagtattaggtgtttctcctgagaaagctccagatgaaccagaataccttacaatgacatttgaagctggtgttcctaagacaatcaacggcgaagagatgaaggttgctgacattatccgtaagttaaatgaattaggcggcaaacatggtatcggtatcgttgatatcgttgagaaccgtgttgtaggtatgaagtcccgtggtgtttatgagactccaggcggaacaatccttatggaagctcacagacagttagaggaactcgtactcgaccgtgacactatggcagtaaagaaagatatgggtaacaagcttgctcaggttgtatacgaaggaaaatggttcacaccacttcgcgaggcaatccaggcattcgtagagtccacacagaaatatgtaaccggtgaagttaagttcaaactttacaaaggtaacatcatcaaagccggaacaacttctccatatagtctttacagtgagacacttgcttcctttacaactggtgaccagtatgaccaccatgatgcggaaggattcatcactttatttggacttccattaaaagttcgtgcaatgagaatgcaggaattagagaaaaaccacagtaaataataaattctgagttgccgcaggcaggagacgcccactgaaagggattgcctaagacagacgaaccgtggaaaaggccactatagaaaatggacaaatagtcgcggacgcacaaaatgctcagccgcatttttgctgctccgatagtccattttctatagtggcctttttcacgggtctgttttctggctaactttttcagtgggcgtctaccttgcctgcggcaaaccagaatttttgcaaaaccattgacttttctgttaaattatgtatattatataagtgaagaatctttcaacatatatcagaatggaggtagcgcatatgccagattctacgatgttacaatcagaagatttgcaggaacgctacgaaagatataaagctaagataaagaactttacgataatgaatgatatcttcatgcggaatgtattgaagaaaaaggaatgtacagaatacatcttacaggttattatggaagataaagggattacggttatagaccaggctttacagaaggattataaaaacttgcaggggcgttctgccactttagactgtgtggcaaaggctgccagcaacagacagtttaatgtggagattcagggtgataatgaaggggcttcccctaagagggctcgataccactgcggtttattggatatgaatatcctgaatcccggagaatcttttgatgctcttccggacacctatgtcatatttattaccagaaatgatatattaggctttcatttaccaatctatcatattgataaagaagtcatcgaaaccaaagagccattcgatgacggacaacatatcatctacgtgaacgcaagcagaagagattctacagaattggggcacctgatgcatgatctgcactgtaaagatgccagtgaaatgtatagcgatatcctgtctacaagagtacgggaattaaaagaatctgagaagggagtggaggaaatgtgtaaagaattagaagaaatttataatgaaggggaacaatccggtgtacaaaaaggtatacaaaagggtgaattaaaaaaagcaagagagactgtctttgcccttcttgaaatgggtatgcctttagaacagattacaaaagcagtaaaaatcccactgacaactgttcaaagctggattgcggaaacaaaattctaatttgccagtgcaactgacggggagataaacagacgccccagccatagcacagcccatcgaaagcagagaatctataaaattgtgacttggagcaagctcttaatacgagcacggtaagcgagtattaagagtgcagggatacggaacaactttatagattctctgctttcgatgggcgtctatcttgcctgcggcaaaatagaatttatttttttatcttgatttttacgctctgttttttgccacttccatccgttgccatagcggtaatcttaacacttttgcccttggcggttttcttcgttttcacaattcccttggcatttactgtggcatactttgtattgctagatgtccagcgaagctttgtattcgccttcttggtggcggtgactttggcttttaattttagttttttgcctgcctttacggatttgcttcctgtaatcttgactttctttacgattcctttcatcgatgtgatctgccaggaggcggactttctgctgccatcagttgcggttgctgtaatggttacctttttaccgcctgtgtttttctttaaggtaactacgccgccctgtgttacggtggcaacctttgtattactggatttccatgttagcttcttgttggaggcattggctggtaaaacggttggttttagtgtgacttttttacctgaagcaatctgtttggagatggcggagagggtaatcttctgtatttttttgttgctggtacctggcttaacaactgctgtctttttttgtttgattacgaaattgcacaattggacaccctcataatctccgattcctgcaatccatatatttccctttcccggtttgatattattattatattctaattcataatccgtatcagcctttaacaagagacctttatatctcacttccactgccggtcttatctcttgccctgtttctgtatgctcttttttgtaagagacactggcttccccgatatcctttttctttgcaacagaataaataactttaaacacattggtttcacctaatatttgtttgatattggtttctactggtgtataaccggcgatttccggaatggataacgtgatagtttcgccggtagtgccgcttcctgtcacattttcatgtatcttctctccacatgtatcctgatagagaacagtgtactcgcattgttccgatcgaacctgtactgttgtttttgtcttaacaccattataatataaaacaacttcgttcctgccaatttgctttgcggtaaaatctccggtaaatccttctttgatgtcctttgttgttccatccacataggttactgttaattctaagccggtaagatcaattggttctgacatagcatattctgtcttatccatatttttctttacagatatagctgtcaccgtcttttctcttccagtgaatgtatttccgttttgttctgcataattatgtgcctgtgagtcagcagctgcttctatagatatattatctccaaaggcattttcattaatagtatttacagtatccggaacattgattatacttaaatcttcgcaaccagcaaatacatttgtttcaattgtttttaatccattttctaaaaatacctgttttaatgcagtacagtcctggaacgctccctctttaatcgtagttactgtatctggaatagtaaccgcaaacgcttctgttttattatcaaataagtctgtattgacagcctctacctcgtatccatccacttctgatggaatatccagacaataactatcttcattctccattgccataacatttagtgcaaatggagaacttactcttgcacttctacctgtacctggattcactttagtgattgttgctttatctccagacaatgtatatgaatacgaagcatttgcattttgcagacaggactggatgtagttcttatatgtcagtttcgattcatatttcttaatatccttttttaatttcttataataagaatcagagccagaataatcctccatatatcccggtgtttggagcatacacgaaagatacagttcaaacgcatcctgataattgtttttgagtgttgccgtattatatacattgttagctatattcaatcgctgattgcttactgcaagcttcaaccagctctgatcaagtaatgcatactgtactttcagataatcctgtacatcaatcactccagcttttttaagaataaaattcaagccagtataaataagatcaactaccgcaaccgttaccgatgctgtcgttcctgctcctgttaccttcgctgtaatccatccgatagcatcggtgattccactggtatcaagcatttctaatgcaaaatttactgcatcctgtctttttattttttcgtaattaatctttaatccctgataaacagtgctatccttatccaccagtgacatataatgtttttgtgtatcttctgttgtgatacgaagaatctctattgatacagcaacctgataagctgaaattgcttttccagacgttttaaatactgaggatacttttttcattacctctgatgattttaatatcttttttaaatcctgctctactttcagatcatcaccataggaaaaaatagcattaatcgctttggcaaattcttcaatgtcctcatcttcagcaacccatttcagcgtatccccgactttaccagaacccttttttaacaggctcacaacctttttgctcttgctcagagaatcggttgcctcatcatatacattggcacaataatctgaatattcttttgcatgattgacataatctaatgccagtgcagactgcactttttctgcctgaatatttttattgaaagccttactaacaagagattctccgattctctttaactgacctgatatcccatcgctcataactgttctcgctgcaattgatatatcgtcccatttacagtttctacttacatctgacatatccgtccataacgtttcaaacattttattgtatgttgtattattcagatatttgcaatattctggcgtaaaaagcatatcttctgttactttcgttggtgtagtggtagtctctccttctggctttcccggattcacaggattatcactgccgctctccccggacttcatcacatccgagcataccgttccggcgtaggaatagagattggaagatgagagattcaaatgcaaagcgggccgcacaccgccaatataatagctgacataattgccatacctgtagacccagccatcattactcacttcggccgcattatagctatagtagcccggcgagcggagccaccacacaatcttatcccttatatcttctcaggtcactccgtgcccagacagttatcatcctgtttacttcgtaagcctgtgtcgatatctgttcatattgtttcggtaaaatacactgattttctcttgcataataaagaagattactatatagtaaagtaaatttatggaattaaaggatgattgattacagattttcatgactggaaaggcgatctggaacttttaaattttaaatattataatgataggcattgcagaaaatattcctgccaaagaagaaagctatgaattacatcgcctgttagcaactattttgtcatcgaatttagaagcgaacgagaaactggatataatggaaagggaataccatatcctcctggaagatgatataagagaggaagtggaagaaatgtgcaacttaagtcagggcattaaagaaaaagcatatcaaggtggttatgaattaggacatgaaagtggctatgcagaaatcatttttaaaatgtatgaatcaggtctgccaatagaacatctgctattacaaaattgagtgaagataagataaaacaactattaaaaggtgtttctgagaatgtctgattaaggtaaaatcacaaaatcaaagttctgtgctatggatttaacagaccaaaaaatcttttacaataaatttcagctatgctccagccatagcacagcccactgaaaatttagacaaaaaacaaaaccgtgaaaagtccggcttagttaaccgctttcagcgggcatctgtccagaccatctgttttcctcgtcaactccgttgacaatgcaatttataaattatttttcttaatatagatgtctatatatttcatggcgtctcttccatgatctgctgtcaagaattccattccctgtgagcgaacatatttatagaacttaattaaaagctcttcattgatcgtaatgttattcagcccataacacataactacatctaactcttttttctctattgcttccataatacggcggaaacttggtctgtccgtattctctgaatcatattgtccaaaatctgtataatgaaggaactcacagttctcttttccatagatttcttctgctacttcatggcatttttcataggattctaccatctcttggataaaatgtctgtaacacagtttacaggctcctctataatactgataatgataaatacctattctctttttcattttcattccaccccgtccatttataataaaaaatataattattatttattataaaacagcaggtaatctaatatagatacagattcacacaaaatctgggaaatatgtggagtgagataaagtaacagacaaagcccaagaattatgttaacaaaaatattttatttcaccaaaacggttaatccattcgtttatgatatcatcactgtttgcagctatcatccgcattaatttttttaatattctttcaggaatctgtgaattattattagaaagaattacattcccagtgctggtaatccaaatttttgttgcagtggatttagctcgcccttcagatatatggacatgaataggttctaacggatcaccttcattagaccaaaaataaatactgtatggtccaattctaagaagttgcggcatttaaaacgcccccttcttgcgaaaactctataataagatgagcatttttacgaatcaactgtttaaaataggatatttctgtatcactatatccttcaatattttcccatttataggctggcaaccaacatgttgcattatggaatccacctacttcatctggagtttcaatatacacttttacactaccatctgccttcatctcagaatgagtgatttccgtatcatcattcagcgtcataaaaggatacatcataaatatccctcccttctatctgttatatttattgtaatataagtaataatacattgcaacaactcaaatctaaatcccgattgaacaacatcgcgacgtgatggcttaggaaagctatggcacaacgatgttgctcaatcagattttttgctattgttttcttcttcccattcttccttcctcatttttgactgtataattgccacaccaactactatgataaatccaataattatttccagacctattgcaatactttctccaatgctcataccttgaaatatattcattctttcctttgatactattggaaatatcacccacaagaatcctacagccacttcgattccctgtattcatttatttgaattacgcaattttctttctggcattttttcatcaagataacacatacagaaaaaactactgctgccaagatccagtaaattatatttattctattaatagaaggccatttttcagataattgaaatggcagcatgagcaattccaagctcacaaattcgagaatatagattactatctgtactccataaagctgtttttcatcaagggaagcaagtaacattttttctgtttcttttttatattctttttcctgtattttttctcccgcaaagaattcgccaatacttatattcaattctttgcaaagagattctataattcctacatctggtatagatcgtccattttcccactttgaaaccgcccggtctgttactcctaatttttctgccagttctttttgtgtcaaatttagatcctttcgattttgtgctatgaaccttcctacttttattggctcaaccatattttcacgctcccataaaataataatctttatttccaaatttctccttagaaatcatgtttttgatatagatatcctaacatatttatggtaaaaatcagaatttaaaaagcgcctcccttatgacatcatccatccaaatacacaatggagtggcaaaaaaccatatgataagaaacggaatacaaatctgtccccgataattaaaagggacctttgagtaatcccatacattaagcttcaaataaatattcacaataactccagtcaaatattcataagaaatgataataagactccccaatatcatctgaaaaagaaaagagggatgccattttttcccttcatttaacaaaccaatagtataaaaagacagacctccgcaaataatcatagatacatgagaatatccccgatataaaatctcaaaattaaaatatgccattcctccaaaactaataagaaataatggctgcgctatttttgttattacaaaatctttcattctccgccgctcctaaaacacaatatttattgtggatagtatttgactacggagttttttctatacttttattattttacttttttaaatttcactggtcgacatttttttgcataataatcatctttctctgcctgctttttactaattctttttttagaaatgactcattttttatcctcttacagcaagaagactccgacctctaaggtgggagatgaattgcgtctgctacctacttgatagagcatcctaattatagtatagtatctttagtcggataataaaaaattgagataataacgcacgtttagtattcttactatactatcatcttgtgcttgtgttcaagtatcgcaggtgggttttcgaggaaaaggaagtggcatggtggcaaacagagcatataaattcagaatgtatcccaatgatgaacagaagattttgtttgctaagacttttggctgtgtgagaatggtatacaatcattggcttgatagaaagatcaggcagtacgaggagaacaagacaaacgtaatatataccatttgtgcaaaagaaatggctgcaatgaagaaaacagaagaatacagatttttaaaggaagcagatagtattgcattacaacaatcgctcaggcatcttgatacggcatttcagaacttttttaaacagccgaaaacaggtttcccaaggtttaaatcaaaaaagcggaataaaaacagctattccacagtttgcatcaatgggaacataactatatctaatggatatttgaaattacctaagattggccaagtccgcttaaaacagcacaggattattccagaggaatacagcctcagatctgtaacagtaagtcagacatcaagtggaaaatactatgcaagtatcctttttgagtatgaagaccaagtacaggaaaaagagatgcaaaagtttttaggtttagatttttccatgcatgaattatatcgtgacagcaacggtaaggagcctgcctatccggggtattacaggaatgcggagaaaaaattagcgagagaacaacgtaagctttccaaaatgcagaaaggttcaaacaatcgcaataagcagaggcttaaggtaacaaaacttcacgaaaaggtttccaatcaacgaaaagactttctacataagcagtcaagacagataaccaatgcttatgattgcgtatgtatagaagatttggatatgaaagcaatgtcgcggtcactgaattttgggaaatctgttttggataacggctggggaatgttcacaacatttttgagatacaaactggaggaacaggggaaaaagcttgtgagagtggatagattttttgcaagcagccagacctgttctgtttgtggttacaaaaatgcaaaaacgaaaaatcttgcgataagagagtgggattgtccgcagtgtggaacacatcacgacagagatgtaaatgcggcagtaaatatcagaaatgagggaatgcggctggtaaatacatgaccttaacacaatataacacaaccgtgggacacacggggatagctcgcttatgcttagcacagtagtgttatcgaacgagaaccaaacttgccgaggttgggaagctcccacctctataggacgccactgaaaaagtggtaagtttaataccgcagagcatcaactatgtgtgaaaatgttccttgataataaaatattgctaaaatagtgttttgagagatgcaaaatctacccttttgagagatggattttcctatttttcctcatttaggcagacttctccctttagttttaaaattcgttttaaattgactacaaatattgatactgctccttgaagttgcatgtttgatagtccagcagcatcacaacgactatatccgtgtatattttttaattcactattttttgcctctatcatatagcgggttttgaaacgttccttgaaatattgtgttttttgaaacgcctcttgatttttatgataatccgatttaatagtgatactatacgttttggtttttgcattttccttataacagccattacgataaggacagacatgacatttattaatatcgaaaaaatatttgatacgtgcattctttttctgattactacgtttgtcaattcgatattttatagccaaatgccctgctgggcactgcatgatatccgcatctttattaaagataaagccgtcctctgaacgagtcccttttatgatgcacgggttaagctttgaaattaatttatagtcattgctttgtgcatcttttaaattttccagtgtggaatatgcggtatctgctattacttcattaacggttacacctgctactttacttttttgaaccagtactggaagttcctgaccatcaaatgcttcgccggatgtgattgttgctgctgtgatgattcgttcatctgtcatggccaaatgagttttgtatccgtaaaaagaagaattgaccgttttatggccaatccgggcatctggatcaatggattgatcataacaatcaatctgattatccaaaatttcggataacatagaagagtcttctttaatcgttggcagttctgaatacggactttcctggactgtgtttaataattcatgacagtattcattatactcatctaaagaagcacatttttcaggttcatctggcagataaatgtctttatcagaatcttttaaagctgcttttaaagaagtagaggcttttttcaacatttctctctgagtagttttatgataacgggcttctgtatgagttgagtcaacaataatagaattgctttttaaaacaccttggtttatggcaagttctacacttttatttatgagcagatcaagtatattttcatcttttaaacgctgctttctgaattttgttaaaagactgggatggataacctcttcttctggcgttaattccagaaaatatttaaaagacatatcatatcgtgatctttcaacaacaccattatcagaaaggttataaagatatttcaaaagcagatatttaaatagcaatatagggttttttgcattacgtccattatcaaggcaatatttattttttaattcatcatatataaaagaaaaatcgaccaattccctgatttttcttagaatatgatcttttggaacaatcatgttatataaatctgaataataactaaggttaagtttaagctgggatgataacatttcaacctccgacaattatgataccttaattatatcagatatatgattttacgaccactttttcagtggcgtcctataggtgggggaggatgtcgctatgctttattattgccttttcatgataatatggcacatcatttaaatatattcccaagcttgtatccaattttcctaccccatttttcactttcaatctacaagaaaaatggtgaccaccataaactagatattttttacgttgactaagttcagtacctgtaccaccaccacctatatatccaatgtagcgaactttctttttataatactgaaaccgttcctgcaattcccagcattagaaaaaacagattattgccctctttaaactttttttcataatcatactcctttaaaacttaatgtaaatatatcagaaatccatgaacttcggaagctaaaattcttatttcacttttccagccaaagcacagccttctgagaatgaaataatccttatttgtggcctcgaagcaaggtttggatgcaagcaaatagggcgcgcattcaaaccgccgcgactaaagtcacaaataaggattatttcattctcggaaggtgtctaccttgcctgcggcaaatcaacttttacagtactttggagagaaactcctgtgttctggcctctttcggattatcaaagatatcctccggtgttccctgttcaaggattcttccctcatccataaacataacacgagtccccacttctttggcaaatcccatctcgtgggttactactgccattgtcattccctgatcggcaaggtttttcattacttctaaaacttctcctaccatttccgggtcaagggcggatgttggttcatcaaaaagcatcattttcggcttcatcgcaagagaacgaacgatggcaattctctgtttctgtccaccggataactgtcccggataagcatctgctttttcttctaagttaaccaatttaagaagtctaagagcttcttcttttgcttcttctgacttcattaacttcagacgtaccggtgcaagtgtaatattttccatgatcgtcttatgtgggaaaaggttgaaatgctgaaataccattcccatatgctgacgcactttattaatgtctgtttttggatctgtaatatcaatgccatcaaagataatctgtccggatgtcggacgctctaagaggttcatgcagcgaagaaaggttgacttaccagaaccagatggtccgatgataacgattttctcgcctggagcgatatgttcattaatatcttttaatacctgatggtctccaaaagatttgcataaatttttaacggatatcactttctcttaatctcctttccagtttgcccataagccatgtaaagaacatgacaattacaaggtaaattactgctacgattaataatggcatcatagcatcgtatgttataccacggataatatctccgcctctggttaactcgttaagaccgatataaccacagatagatgtttcttttaataatgtgatcatttcatttactaatgccggcaggcagtttttgattgcctgtggcatgataatctgtaacatggtatctgtatagccaagtcctaaggaacgtcctgcttccatctgtcctttatcaacagacatgatacctgaacggaaaatttctgcaacatatgccccggagttcacaccaaatgtgataaccgctaccataactttattgttagaagatgctaaaacaataaagaacataatcaataactgtaccatcgttggcgtaccacgaataactgtcagatacactcgacagatcaggtctgccagcttaatcagaaaacttccaaaacctttactctgatcttctttcagctgatcatgtgttgtacggattaccgcaatgactgctccaagaactaatcccagaatcaatgcaagaaatgttacttctaatgttactttaagaccatctgtaatgtacttccaacgctgatctgcaataaagtccaatataaactttgcttttatgcctgaaaaccactcactcaaaatctcaaccttctctttcttaaatattcattcgtatttacctgttactttgtgacatcctcccccacctgtagaggtggtggcttcccaacctcggcaagtttggttctcgttcgataacacttctgtgctaagcatatgcgagctatccccgtgtgtcccacggttgtgttatattgtgttaaggtcatgtatttaccagccgcattccctcatttctgatatttaccgccgcatttacatctctgtcatgatgggtcccgcattgcggacaatcccactctcttaacgcaagatttttcgtttttgcatttttgtaaccacaaacagaacaggtctggctgcttgcaaaaaatctacccaccttcacaagtttcttaccctcatcctccagtttgtatctcaaaaatgttataaaacaaaagagtacccgggacaactgccccgggtatggaaagcggtatacactgcttcctactttttcatatcatagctacaatctccgtaactacgtataattatttgatgtatttgtcaagaatcttctggatagttccatcttctttcagctcttttaatgctccgtttactgcgttaagtaaatcagtattgcctttctgaattgctgctgcataatcttcctgaacataatctgtatcaagaatctgtaaaccatctgttgtctcaacgaaagacttcgctggctggttatcaatgattactgcatcaatcttaccgcttgtaagagccataactgcgtcagcacctttattgtattcttctacgttttcttcgccaaagtcatcttttgcgtagatgtcaccagttgttgctaactgcacaccaatctttttaccttttaagtcatcaatagacttaatggaagaaccttcttttacgataacggactgaatacctgttgcatagctgtcagtgaagtcaacagactgctttctctcatctgttacagtcatacctgcaagacctaaatctgctttacctgactgtactgctgtgatgatagagttaaattccatatcctgaatctccaacttcagtcctaatttatctgcgatcgcttttgcgatgtcagcatcaataccaacaatatcattaccctcataagattcatatggtgggaatgtcgcattcgttgccattgttaacacaccatcttttgctgtctttactgtagctgttccattagcagaagtactggattctgctgactttttgtcgttgctgctaccgcatccagctaacatagatacagacataacaactgcaagcgcaacggctgctaattttttcatcttcatttttctctctcctttgtttcatttcattacaagtttttctaaaaaaatttgcgtattgtaagaaagctacacaaagctttcttctagatataaaaaataccacaaaccgaataaaaacacaagtgcttcctgcatattctttgaataaatattcatcaaacttactttgaattaataaaatgaacatgtactatgcatttttatacttttcttcggatatccggaagctgcgctaatacaatcgcaataaacataagtgcacagccaatcaattctcttgttgtaagaacctgatgaaggaacaaatatcctgaaagggcggaaaatacagattctaaactcataatcagtgccgctaccgttggatttaatcctttttgtcccagaatctgcaacgtatatcctactcctgttgacataatacctgtataaagaatcgggcctgccgcatttaaaatcattgccatattcggactttcaaataaaaacatacagattgcgccaagcattccgccggtaaggaactgaatgcaagacatttttaccccatctacaaatggattataatggtctatcgcgagaatctgtcctgtgtataaaaaggaacagcataaaatgagagcatcccctctctgaattgtcattttttctgtaatacataaaaaatacagcccggctaatgcgataactacgccaatccaagtgaggattccgcagtattttttaaagaaaaggccgacaaccggtacgataataatataaaatgttgtgataaatcctgcctttcctacggttgtgtactgaattcccgtctgctgaaaacagtttgctaaaaataaaaatattccgcatacaattccactttctaaaagccgcttatttttccagcttaatttttcttcctctgcctgcatcttttgaaagctgttaataccgttatctgaggctgtttttacactttcactccgtcttttttttcgaatattatcaatgaccataatgaccggaatcagaaataatcctccaatcacggagcgaagacaaataaatgtaaatggtccgatataatccatacttacactctgtgctacgaatgctgcaccccatatcattgctgtcagaaacagaaaaatcgtgtctcgtatcttatgtgttttcatctccatttcttcttttcttcctcttttcctctcaaacttacctgcaaatctcgcagataaaacagattatactccaatcttattatgtaaacaagatattttctgcctttttccttgccagttactttattttcatgtagaatattcatttagaacacttttaaaatttacaatacaggaggaatttttatggctcagttatggggcggacgattcacaaaagaaaccgacaaactggtttacaattttaatgcgtccatcaattttgataagaagttttacaaacaggatatggaaggaagcatcgctcatgtaaagatgcttgccgctgttggtatcctcacagacgaggaaagagacaaaattatcgctggcattgaaggtatccttcgtgacgtggagaatggttctcttgaaatcacagaggaatatgaagatattcacagctttgtagaggcagtcctcacagaccgcatcggtgatgtcggtaagaaacttcacacaggaagaagccgtaatgatcaagttgcccttgatatgaagttatatacaagacaggagcttcttgcaatccgagaacttgttcttgaactcatcaagacatgtcagaccttaatggaagaaaatatccacacagttatgcctgggtttacacatttacagaaggcacaacctcttacactttctcaccatgttggtgcttatatggaaatgtttaaaagagactattctcgcttaagtgacatttatgaccgaatgaactactgtccattaggttctggtgccttagcaggaacaacctaccctttagacagagaaatgaccgcggaacttcttgacttttacggtcctactttaaacagcatggattccgtatctgacagagattatgttatcgagttattaagtgctctttctacaattatgatgcatttaagccgtttctgtgaggaaatcattctctggaactctaatgagtaccgtttcattgaaattgacgatgcttacagtacaggaagcagtattatgccacagaagaaaaatccagatatcgcggaattaatccgcggaaagactggtcgtgtttatgccgctttaacatctattttaactactatgaaaggaatcccactggcatataacaaagatatgcaggaggataaagaactcacctttgatgcatatgacactgtaaagggctgccttgccctctttaacggtatgttaaagacaattactttccataaagacatcatggagcagagtgccaaacatggctttacaaacgctaccgatgcagcagattaccttgtaaatcatggggttccattccgcgatgctcatggaattgtgggacgtcttgtactgtattgtatcgacaaaggaattgctcttgatgatatgagtcttgaagaatataaagcaatcagtcctgtatttgaaaatgacatttatgaggtaattgatgttcatacttgtgttgacaagagaaatactatcggtgccccaggtccaaaagcaatggaacaggtcatcgcgatcaataaaaaatggattgaagaacacgaagagtaaacagggagaataactatgaaacattcaaaaaagtcacataaagagggccgaggaagtttttccggccgtatcggctatgtgctggccgttgccggttctgctgtaggtcttggaaacatctggcgttttccataccttgctgcaaaatatggaggaggaatctttcttttagtttatctccttttaactgtatcttttggatatgttcttattatgtccgaaacagctcttgggcgtatgactaaaaaaagtccggtaggtgcatttgcttcttttggtaatagctttccttttaaactgggaggctggctcaatgcggttattcctatcctgatcgttccttattatagtacgatcggtggatgggttatcaaatatcttgctgaatatttaaaaggaaatgtgcaggaagttgcacaggatggctactttaccgaattcatcacagattcttttcaaacagaactgtggtttcttgtttttgcagcattaatctttattatcatccttggcggtgtaagaaatggagtagaacgaatgtctaaaatcatgatgccaattcttgtacttttagcaatcgttgtaacaatatattccgttacacgtccgggcgcattagccggagtaaagtatttcttaattcctaacatgaagaatttttcttttatgacaattgttgctgcaatgggacagatgttttattctctttccattgctatgggaatcctttacacctacggttcttatacagataaagatatggatcttgaacaatccacaacacagattgaaatctttgatacagggattgcaatacttgccggattaatgatcattcctgctgttttctctttctctggtggaaatcctgaaaacttacaggccggaccatccctcatgtttattactttaccaaaagtatttgccagtatgggaatcggtaccgcagctggtatcctgttctttgtactcgtgctgctggcagctcttacaagtgcagtatctttaatggaaacctgtgtatctacttttgcagatgaatttcactggagccgtaaaaaatgttgtgtattcatggctgttgttatgattgttcttggttccgcatcttctatgggatacggtgcccttgatttcattcagatcttcggaatggcattccttgatttctttgatttccttacaaactctgtaatgatgccgcttgctgctttagcaacctgcttcttaatcctcagggttgttggatttaagaaaatctcagaagaaatcgaacagtcttcttctttccgcagaaagaagttatacactgtcttccttaaatatttcgcaccaatctgcctgattattattttgtgcagttctatcgcgaatgtattaggaattatttctatgtaaacttaatacagacaaaaaccggggaaatcatatacttccccggtttttattattattttattgcccatctcatttttgtagatcttgctctgccgtttcgatggcattcttcttttgaagggcggatgacattctttgccacctcactccataacccttccttctgctgtcttttccagattttctttactaatctgtcctctccggaatggaacgtgagaatcgctacacgtccgcccggtgcaagtatatgtggtaacttttctaagaattcttctagtacttcaaattcgctgtttacatcaatgcgaagtgcctgaaaggttctctggcaagtcttcttgatggtatcctttttttctttatcatctggcagaaatacaagcgctctttcaataacttcttttagctgtcctgtcgtatcgatttgttctccttgacgaaatgtcttcataatctcttttgcaatctgttctgcataaggctcatctgcattctcacgcagcataccttctatttcatctctggttaattctcttaaccgttctgctgcagaaattcccttatccggattcaaacgaagatccaaaggcccttctactttataagaaaagcctcgttccggattatcaatctgcatggaggataccccaagatcggctaatacaaaatcaaataatccatgttcttccgctacaagatcaatgttgcggaaattctgctgtatgatcgttaaaatatcttccccatatcctgctttccttaaacgatccgttgtttttacaatttcaatcggatccacatctaatccatagatatggccttcgccttggagacattctaacatctttcttgtatgtcctccgtatccaagtgtacagtctaatcctttttgtcccggctggatctgtaaaaaatccaaaatctcctgcacacaaatagatatatgcattcccgccggagtacttcctttacggattactttctcaatcgtatctttatacttttccggctgtagttctttatatttctcttcaaactttcttggatgcgttcctttataacgcactcgtcttttatgtggtttttctaattctttattttcttccataggaacccctgtataatttttatgtattctcataatctcttgtatttcatcttatgagacatctttttattcttatatcatgataacacaggttaacgaacagaaacaacaaaatcagtccatacatccttgttttttcttcatccatgcataggcaattacacagatcattacagaaagaagggaacctcctactgtagctaagcccatcggaaaaaggctggaaaatactttagctgtaatatacactcccggtattcttacaagaagaatcgctataatgttatggataaaggaaagttctgaatgtccacaggcacaaaagtaaccactgaaactgaaatggatacctgcaaatatacagtcaaatatatatcccctgatatactgggaaccaagtactattacttttgcattttctgtgaacaagccaactaccggtcctgcaataaactgcatgataattgatatcattacaccaaaccctacggtaatcagcactgcataataaagtatcctctgtgctctttccctcttgcctgcaccgatattctgcgctccaagtgcagatacagtagaaagcatagaagatggtaccagaaagaggaaactgataattttttctacaattcctaccgccgcagcagtatcgagtccccgcctgtttgcaataatagtgataattataaaagcaatctggataaatccatcctgcagcgcgacaggaataccaatttttaataatcgttttattgttttcctgtctatcttaaaatcatttttagaaagagagattcctgtcttttttttcataataacgacaagagcaatcagtacactgattgtctgtgagcaagtcgttcctaatgctgctcccgctgcacccatatgcagtccgccaataaaaagataatctaaaataatatttatagcacaggctgctgcaataaagtacatcgggcttttagaatctcctattcctctaaaaatagaactgataatattataggcagtaataaaaggaattcccagaaaacagatggtaagataaataactgtttcatgaactgcttcctgcggtgttgacatcatgccgacaatgggtttgataaaaaataaaagacctgctgctcctacaattgccagcatcataaaaagggtgactgtattcccaatatctttggctgcttttttcttattgcccgccccaatcgcctgtccgatattaaccgttgctcccatagcaagaccaacgatcattaccgtaatcatatgcattacctggctgccgatagatactgccgttatactcgaaatatcttcaaactgtccgataataaacaagtcggccataccgtaaagcgtctgtaaaaaataggataataaatagggcagagaaaaatataaaatactcttcaaaacactgcccgtcgttaagttcttctccattgtaaattttctccctcttattcttctcttattctttttcctgcggaatcaaatttacatcaagctgttcaaatggaatagcaatattgttattgtcaaattcttctttaatttcttccaatactctccaacgtgattcccaataatcctctgtttttacccagtaacgaatccctatatctatagaacttgcctgaaattcatttacgtaaattttaaccggctcatctgtaattcttgccggttctttttctattaaagcatttaatacttttctgacttttttgatatcttcactatattcaatactgacattcagatcaacacgtcgtttttcctgataagttacattcgtaatactagcatttgataaatttccatttggtatcatgatcgctttattgtctacacttaaaagctttgtatacataattccaattgcctgtacagttccttctttcccagagtttccctcaataatataatccccaacctgaaatggttttaataataacaaaataacaccaccggcaatattcgacagtgaaccctgtaaagaaagaccaagagcaagaccggcagaaccaagtaatgccacaatagatgaggctgctacgccaatctttgttaccgccataaaaataacaagtaccttaccgccaatcttaataaaagaaagcaggaaggtctgcagcgttgtgtccataatcgaacgctcaaaaatcttatgtgccatttttaccacataggatacgattttaaaaccgatgaataaaatcagcagtgccccgataatgtcaccacaaaaatctgccagtttcactcctgttttaccaaggtattcatagataagtgagtgagcaaaagacttcaatgaagctgcttctaacaacataaaaaacctcctaaaaaaagaaaaatgatatatcccagatatcgctttagagcgtgtttaaaatgtagacaggcatcttaaacaaagcggctgcaaagcagatgggatatatcattttttatttttcacctatatcaaatctacaaatcagaatttattttgctgtgatatatccctgtgctgttaataattctgcacaaagtacagctccgccggctgcgccacgtactgtattatgagataatcctacaaatttataatcaaacattgtatcttctcttaaacgtcccatggagattcccattccattttcaaaatcaatgtctaatttaacctgtggacggttatcttcttccatataacgtatgaactgctttggtgcgcttggtaagttaagctcctgtggaagtcctttgaagttttcccaacggtcgatgatttcttctttggttggtttcttttcaaagtttacgaatacggctgctgtatgtccatcaagtacaggtacacggatacactgtgttgtgattaatggtgcagttgctttttcgattttgccgtctacaactttaccgaataatcttaatggttcctgctcggatttttcttcttcgccaccgatgaatgggatgatgttttctaccatttccggccagtctttgaatgtcttacctgctccggagattgcctggtatgttgttgccacaacttccttaggaccaaattcttttaatgcaaaaagtgctggagcgtagctctggatggaacagtttggttttactgctacgaaacctttctttgttccaagacgttttttctgtgcctcgattacctcaaaatgttctgggttaatttcaggtactaccattggtacgtctggtgtccatctatgtgcgctgttgttagaaactacaggtgtttctgtctttgcgtaagcatcctcgatcgcacggatttcttctttgctcatatctacagcactgaatacgaagtctacttcagaagctactttttctacttcgtttacgttcattaccacgatattctttacagcttccggcatcgctttctgcattttccatcttccgcctactgcttcctcatatgtttttcctgcagaacgtggacttgctgcgattgctactacttcaaaccaagggtgattctctaaaagagagataaatctctgtccaaccattcctgtaccaccaaggatacctacttttaatttctgatccattttcctatgtcacctttctgtgtaaaataactatgggtttattcctgttttttattttcaatagctatccaaagccatattgctctggacagttatttttgatgtatattattataattatttaaccactcttaccttaagtacaccttcaatatctatgatatgctgtacagattcttctgtaattacagaatccacatcgaagattgcgtaagcataatcgccttttgtcttgttgctcatttctgtgatgttgatattgtcttttgcaaatgcacctgtgaaacgagtcagcatgtttggaatatttctatgtaaaatagcaatacgtccctgtgtctggcatacaccaagctgtgtgtttgggtagtttacagagtttgtgatattaccattctccagataatccataagctggtctactgccatctctgcacagttatcttcggattcttctgtggatgccccaagatgagggaatgcgataaccccctttactcctgctacctttggtgtagggaagtctgttacataatgtgccagcttaccattgtctaatgctgcaactaaagcatcttcatctacaagaccgttacgtgcaaagtttaagataacggcatcttttttcatctttgcaatgccttctgcactaatcatgttctttgtgctgtctaacagtggaacatggattgtgatgaaatcacaattttcaaagatttcatcaatagaagatacatgatgaacggctcttgataaattccatgcggactttacagacaagaatgggtcatatccgtaaacttccatgttgaggttgtgtgcagcattggctacgagaacaccgattgctccaagaccaataacaccaatctttttgttctggatttctcttccggcaaatgcttttttggctttttccattgcctttgtgatgttagggtcttctttgttctcttctacccatttatttccaccgattaagtcacgggatgctaataacattcctgcgataaccatctcttttacaccatttgcattggctcctggcgtgttaaatacaacgattcctttttcagaataatctgcgatagggatgttgtttacaccagctcctgctcttgcaacagctaaaagattcggcacatcctgcatatcatgcattgctgcacttcttactaatacagcatcggctttctgtaattcttctacctgcttatattcttctgtaaaaagagaagttccacatggagagattggatttaagcatttatactgaaacatcattataacttcctttcatttatttagattcttcctgtttttgtttctctaagtcttcttcattgaaagcatcgctgatagaaccgcctggcgctaccatcggccatactttatcatcactgtcgatgatacagtcaaggagatatggttcattagaagcaaccgcttctttgaaagcagcttcaaattcttcaattgtctctacgcgttttgcctttgcacccattgcttctgcaagttttacaaagtctactttatcatagagtgttgtggaggaatatctttccccatagaaaagattctgccactggcgaaccataccaagcacatgattgtttacaactacttcaattaccggaatctctgaacgggttgcagttgcaatctcgttcatattcatacgaaaacagccatctcctgcgatatttacaacaactttatctgggcatccgcatttggcaccgattgctgcgccaaggccgtatcccattgttccaagtccaccggaagtaaggaactgacgagggcgttcgtatttataatactgggctgcccacatctgatgctgtccaacttctgttgtgataatcgcatctccctcggtaagctcgtaaatcttctcaataagtcctggacctgaaagacgttcttgatgataagtcatcggatattttgctttcatatcctgaatttcctgcatccaggcttcatgttgctgctgggaaagtcttctatttaaaatagtaagaactgcctttacatcaccgataattgcagtatcaattaaaatatttttatttacctcagcaggatcaatatcaatctgaatgattttcgctctgctggcaaatgtcttggcattaccataaacacggtcgctgaaacgtgtaccgattgcaatgagtaagtctgattgggataccccgatattcgaagtcttcgttccatgcattcccaacattcctgtataggctggatcctctcctgggaaaacacccttccccataagtgtatcacaaactggggcatcaattttctttacaaactctcttacctgttcactggcatcagataatgtacatccgccaccaagaagaacatatggctgttttgcttcctcaatcatctcgattgcttctttgacactcttttctttgattgtctcacagactgggtgaatcacggctggttccatagattcaaaatatgtctttgctgctgtgacatcttttgtaatatctactaaaaccgggccttttcttcctgactgtgcaatctggaatgcctcacggatggtatccgcaagtttttcaatatcttttacaatatagttatgttttgttactggcattgttacacctttgatatcaatctcctggaaagaatcctttccaagaaggctgacaccaacgtttgctgtaatcgctacgactggaatggaatccatgtaggcagttgccaacccggtcacgaggtttgttgcccccggaccggatgtagccatacatactcctactttaccagttgctctggcataaccatctgctgcatgggaagctccctgctcatgagaagtaagaacatgatggattttgtcactctgtttatataattcatcgtaaatatttaaaatcgctccgcccggataaccgaaaacggtgtctaccccctgctcttttaaacactctaatacgatttctgaaccattaagtacctgcttcattataaatatatcctttccaattattttaactggtcaacatctaaaactgcgcctctgtttccagaagtaacaagagcagcatagcggcgaaggtaaccatctgtaattttgggctctcttggctgccatttttcttttctctttgctaattcttcatcagaaacatcaacatttaagctgttgtttggaatatcaatcttgatgatatctccctcttcaattaaagcaattggccctccaacggctgcttctggggatacatgtccgatagaagctcctctggaagcaccggaaaaacgtccatctgtaattaatgctacagaatcgccaagtcccattcctgcaattgcagaagtaggatttaacatttctctcattccagggccaccctttggtccttcgtaacggataacaacaacatcaccaggaacaatgtcgccacctttgattgccttgattgcatcttcctcacagtcaaatactcttgcaggtccttcatgtaccatcatttcaggaacaacggcagactgttttacgataccagtatctggtgcgatatttccctttaagacagcgattccaccctgtgccatgtaagggttgtcgattggacggatgacttctgggtttaagttatgaacgtctttgatattctctcctactgtctttcctgttacagtaatctggtcttcgtaaagaagtccttttttgctaagttcattcataacagcatatacaccgccagcttcgtttaagtcttccatataagttggtcctgctggtgcaagatggcaaaggtttggtgtttttgcactgatttcattcgcaatatccatgttcagttctacgcctgcttcatgtgcgattgcagggaggtgaagcattgtatttgtagagcatccaagtgccatatctactgttaagcagtttaagaaagctttctttgtcataatgtcgcttgggcgtacattatttttcagtaattccataaccttcatacctgcatgttttgcaagacggattctctcggaatatacggctggaattgtaccattaccccgaagccccataccaagaacctctgtcatacagttcatggagttggctgtgtacataccagaacaggaaccacaggtaggacatactttgttaacgtattcttctaccttttctgctgtcattttaccagcttcataagcacctactgcctcaaacatagaagaaagacttctctttcttccatcaacgtgtcctgctaacattggaccgccacttacaaaaacagttggtacattgatacgtgctgctgccattaaaagtccaggtacgttcttatcacagtttggaatcataactaaagcatcaaactgatgagcttttgccatacattctgtggaatctgcgattaactctcttgttactaaggaatacttcattccagtatgtcccatagcaataccgtcacatacagcaattgcagggaatacaactggtgtaccaccagccatagcaacacccatctttacagcctgtgtgattttgtcaagattcatatgtcctggaacgatctcgttgtaggagcttacgatacctactaaaggtctttccatctcttcttttgtataacctaatgcattaaacagggaacgatgtggtgcctgctgcattcctttttttacgtggtcactattcataattaacctccaatgattcacttagaaatgaaatcttcattttctaaaatataaattatttatccaatgtagatacttcttccattgaatatacccttatccgatacaattctaaataactttcaactacatctagatacgttctgcgataagagttcccatctctttacatccaacctttgtcattccttcagacatgatgtctacagtacggtatccatcttttaatacctgttttactgcattgtctacagcatctgctgcctcatccatattgaaagaataacgaagaagcatagatgcagaaaggatggttgcgattggattggcgatatcctgtcctgcgatatctggtgcagaaccgtggcttggctcatataaaccgaagcttccttcttttaaacttgcagaagataacattccgatagaaccagttaccatacttgcctcatcagataaaatgtcaccaaacatgttctctgtaaggataacgtcgaactgcttaggatctctcactaactgcatggcacagttatcaactaacatatgctctaactctacttccgggtagtcttttgcaacttcgttgacaacctttctccataagcgggaagaatcaagtacattggccttatctacgcttgttactttctttcttctcttcatagcaatatcaaaaccacggatagcgatacgacgaatctcttcctcactgtatgtaagggtatcaacagcctttgtcactccatcttcttcaaatgtctttctttctccaaagtaaagaccacctgttaactctctcataacgacaaggtcaaaaccgtctccgataatgtcttctcttaatgggcaggcgtcttttaactcttcataaagatatgccggtctcatattggcaaataatccaagtcctttacggatagccagaagtcctgcttctggtcttaagtttgccggaagcttataccatggagaagttgttgtattaccaccgatagaacccatcagtacggcatcacagctttttgctgtctctaatgcttcttctgtaagaggctttcctgttgcatcaatggatgcaccgccaagaaggatatctgtgtaatcaaacgtttcgttatatttttctgccactttatctaatactttaagtgcctctgccacgatttccggaccgattccgtctcctcggattacacctactttataactcattgtttcatccctttcctttttcttctatcgtttataccctttatgaattacctcttatcatttcctgcaaattaacaatctaagtgttcatgggtatagatactcacagttaaatatcatatctcatttttctattataatcaatctttttccagacattcctgcactttattgcaaaaatctttccatgcctgctcatgttttacataatatctcggacacatctttccggtaacatcataatgacgaatcacatttttggaagataaaccatacgtcttgcaaatccacgctgtaaggcgcacagccgaattatatgttttgtcattaaacttcccgtttttctttggatggcagcactcaatcgaaatcgtatctttattccggttatttgatgcataagaaatttcgctctgcggaatacattgaataacctctccatctaaaccaacaatataatgactacttgccttggtaagatgcgtgttttgcagattattaaaataatcccgattctcttttgccgtactgcccggattttccacatagtggataacgactccctttaccttccttaaagcaattccacttcggctatacggattcttatctaaaaaatcttctgtaatctctggcctgccacaagggccatcctccgcgggaagtacacggcttccaacatcacttccctcttcctgctttggtgaaattcctgacacgctatttggtttccaaagaaagctactatgtaaaatagaaataaatactgccagaaaaagtattgtaattgccaactgtcttttatttgatatttgttttctcccttttcgttttttcccagacttttttctcttcctcactctatttttcatccagacctgcttttgtccgctggaaaaaaacatcgaatcccttctttctatgaaatattcaatgactgctttcttcagaatactgcttaaattctacacctgacttcataataggaagacgataaaaaaactgcgcagatagagctaaaccccatctgcgcagcctttgcgttcttattattctacactatagtttggtgcttcttttgtgatatgaatatcatgaggatgactctcttttaaggaagctgctgtaatctttacaaactgtcctttctcttttaattcctgaatcgtcttcgctccgcaatatcccataccggaacgtaatcctccaacgagctggaagatggtatcttccaatttacctttataagctacacggccttctacaccttctggtactaacttcttagcgttagcctggaagtaacggtctttacttccgttctccatagctgccagtgagcccattccacggtatactttatattttcttccctgatataactcaaattctcctgggctctcgtcacaacctgcaagaagtccaccaagcattacaacattcgctccggctgcgatagcctttgtaacatcaccagagaacttaattccaccgtctgcgatgattggaatgttatacttatctgccatctcgtaacaatccataacagcggtaatctgtggaacaccgatacctgcaactacacgagtcgtacagatagaaccaggtccgattccaaccttaacagcatcaacaccacattcgatcatggcctttgttccttctgctgttgcgatgttacccgcgataacctgtaagtcaggatacttctctttaactaaagcaaatgtcttcaatacgttagcggaatgtccgtgagcggtatcaataacgataacgtctacatgggacttaacaagctcgtctacacggtttaagatatctggagtacatcctactgctgcaccacagagaagacggccattgctgtccttagcggaatatggataacgaatctgcttttcgatatccttaattgtaattaaaccttttaagttataatcatcatctacgataggtaatttttcttttcttgctttgccaagaatctgttttgcttcttctaaagtaattccctcttttgcagtaactaaaccttcggaagtcatagactctttaatcttcttattaaagtttgtctcaaactttaagtcacggtttgtaataattccgactaatttaccgttctctgtgattggtacaccagagatacggaacttcgccatcaggtcttctgcctgctgtaaggtatgttctggggaaagatagaaaggatctgtaataacaccgttctctgaacgttttaccttgtctacttcttctgcctgggcctcaatggacatattcttatgaatgataccaattcctccctgacgtgccatggcaattgccatctgatgctctgtaactgtatccatgctggcactcataaatggaatgtttaacttaatcttgtttgtaagctttgtctccagattaacttcattcggaataacttctgaatatgctggaactaataacacatcatcaaatgtaattgcttctttaatgatttttcccattgttttcttcctttctatccttgaataatgattaaaaatataactaatattagtaaattatgttagcaaagaaacgcacttttgtcaacgtggcaaataaaacagaatttctcagcaaatcgcgcttaatgttatacaatttcacaatttatgaaaaatagacgaaatgtctgacttcttggggttggggaacagacgcctccggtaagcgaaataaggtctatctgtgactttcgtcgctgcaaatagaagtctgagaaacagccagacagtaaaataatggattttgattccgttgtaaagaacacaaagtcacaaaatccattatttactgcgcggctgttatctatggtcaaactttgcagctcccaggccacagatagaccttatttcgcttaccggaggctgtttgttccaatccgaagatgcatacttttcggtttgtggcaaattgtgaaatggctataatcggaagaacgcggattttccgaaaaatggggaagaaaagggaagtggccgctgaaggatttcgtttaaaatggggttgtatacattttatcgtttgggtttacgaatagaaatcgtttgcagatatttcgccatcttaatatcggcttctatttcttctttcatttcttcgtatgttccttcttcttttgcttcagaaatcatttcttgaatttcttcgtccgtcatgctaaacgaatatgccaggccaattctttttgcctcatatgttcccaattcatcttcgacaggactttgattcaatcttacaatcaattctataacaacatctttcatctcagaaaaaatattagtaccatttagcattacaacatgactatgttcttcatcatttctaatttctatttcatcgatacacttattcgaatctacatgtactaaaagtgatgactcgtaaaaatagtaattatcttcgtacttatcaacttcacccacagctttcacaacagacgaaatactatctccaaacataatctctataccatcacattgaatacccttacccacttcaatctgtactttcattttttaaatatctcccgttcaatatatttttatagacataatattccatcttgtttacaaaagcaagctcacatactattttcttctggagaatccccaaaattactccatcaagtaaataaattctgtatattccaatcctacaaatcacttgaaaaagatttgaggatgagacaagctaattttgcttctacagccaaagcacagccctcaggaaataaaacaatccatatttgtggcctggaagcaagtgttggatacgagcgatagagcgagtattcaacacgcagcgacgaaagtcacaaatatggattgttttggtatgctctggtatgctcccttttaggtagacagttgaaaaaaataaaactgtttatctgaaagggggcattttttatggataagatttctccagaagaaaaaatacaatggatgaaaaaaattcttcagaagaaagaatctatcagttctgttgcgtcaaaaataggagtttattatacgaccgttgataaatggcttagaaattataaagcaattggaccggaagctttttttcgaaaagggcatacctatcgaactcctgcccaaaaagaagccgctgttttcgattacctttctggaaaaggttctctccgggatatctgtgcccggcacaaaatttcagatgcacagatactcagaagatggattatgaagtataatagtcatgataaggaaacaggaggtagagcaatcatgactaaaggcagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatggactgcaggataagcggggaaagagaaaatccccagaggaaatgacggaagtagaaaaactgcgggcagaagtaagacttctgcgtgcggaaaaaagacgggcagaaatagagatatctttcttaaaaaaattagaagagatagagaggaggggaggctgagcctgatacgccaggaacatatctatcgggcaatcaagaaagaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttggggatcttgaaacgggaaatgtattatgggaagaaatttgagagcagagaagaattagagaaagcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccactcccttttaggtagacagttgaaaaaaataaaactgtttatctgaaaggggcattttttatggataagatttctccagaagaaaaaatacaatggatgaaaaaaattcttcagaagaaagaatctatcagttctattgcgtcaaaaataggagtttattatacgaccgttgataaatggcttagaaattataaagcaattggaccggaagctttttttcgaaaaggtcatacctatcgaactcctgctcaaaaagaagccgctgttttcgattacctttctggaaaaggttctctccgggatatctgtgcccggcacaaaatttcagatgcacagatactcagaagatggattatgaagtataatagtcatgataaggaaacaggaggcagaccaatcatgactaaaggcagaaaaactacatttgaagaacgtgtcgagatcgttcaatattgcataaaacattctcataactattcggaaacagcaaaaaaatttcacatttcttatcagcaggccagaagttatactataagatatgaagaaaacggggtggatgggctgcaggataagcggggaaagagaaaatccccagaggaaatgacggaagtagaaaaactgcgggcagaagtaagacttctgcgtgcggaaaaaaggcgggcagaaatagagatatctttcttaaaaaaattagaagagatagagaggaggggaggctgagcctgatacgccaggaacatatctatcgggcaatcaagaaggaacacgaaaaatataactatccaatcctgttattatgtgaaataggagggatcgccaggtcatcctactacaaatggctccatcatgcagagacaccgaatgagagatttaacgaggaattggcagagaagctggaacgattacatgaaaaacatccagatatgggatatagaaggttaaatgacaagctgcgccacgatgaagatattcaggtaaatgataagaggatcctccgtatttgcagaaaaaaacagatccggtccaacttaaagagccggtataatggctgtaccagagcatcaaacaacccagcatttattgcagaaaacattcttaatagagaatttaaggcggaacaccttaatgagaaatgggttaccgatgtaacggaattcaagtatggaaataccttagacagtgtgcataaagtatatttaagcgctatattagacttatgtgatagacggcctgttgcatatgttattggggatagtaataataatgcgctggtatttgaaacttttgataaagcagtaaaggcaaatccaggagcccatcctatttttcacagtgacagaggatatcagtatacctcccgaagatttcatcagaaattggaagaagcaggaatggtacagagtatgtcgagggtagcccactgtacagataacggagtaatggaaggcttttgggggatcttgaaacgggaaatgtattatgggaagaaatttgagagcagagaagaattagagaaggcaatcacagaatatatagattactatacaaacgaccggccacagagaggacttggagtcttaacaccaatggaatttcatgaaaagcaacgattggcggcataaaaatgttgcccgatatccaaccgggcaacacaaaaattttatatttttttaattgtctacttgacgggatgcacaccattttatctcctgagagcgtctaccttgcctgcggcaaaccaggattatttaattgtaattatcacctgctgatagtgtgttaatgtatgttctccatcatcctgtgcctgaacaattaaatgaatcttctgtccggcttttgcatcttctggaatcttgaagctgatggtgtcagaagcagcaccttttaatgttaatgcagtttctgttgtacttgcatctgtgtattcactccagcttactgttacataatcatcatctggatctgttgcgattgcatgtaattttaatgtttctccggcagatgcttttatatctgttccttctgttacggatacttttggtgcatggtttgcttttacataatcattaacgatacaccagtctgctcttgctgcaaaatcattctgaatatcatcaatgtatttccagctagattctaccttcatagtgcttccatcttcttttacataggtatctgttacaggactccagtaatttacttcctgtcctttactgttctttttatctgctctggcatatcttccactaaatccgccgtttgttatatcttcaagcgttctgagacctgtgtcaagtaacataaagaatgttggggaatctccttcagaaaggaaatcatatctctgatatttttgtactggattaaatccgccccaccagtttaaactgtctaataaatcttcatttgttccaaactggcttcctggttcttctccatctaagtaagttccatcgccccaggttacataattgtcaagaagggcaccatgttttcttataagattctttaacataaagtctgcatacagtgtctttttgctggaatcctctggctgtgtacgccacatataggcatagcttgacatctgggaacagctcataaacttaatttccggccattcttctgcaatatactctgaatatgtctcatcctgttcaccacaggcaggaattacaactttgttgataatcttcttacgaatcgcatcccactgttttgttcctttgtactctttttcaatatcttttaatgctctggaaatcgtattcgttccaccccatgccaaaagatacaaggttctctcatcattatcaagaatttttttctttataagttcagaaccttcagttacactatccatttctcctttatatccaatatttccaacctttgtaacactctttaaatatgctggtgcaggatagctcttatcatgtttcttcaaatttggatatattttctggtatgcattcagatatttctgcatccactctgttccaggccagcgatatggttttgtgtacttttcttctttttgtcctgcaacacctttccaatggaatttagaagaagactgcacaataccctgaatatctacttcattagaatataataaaacatgaatcaacgaattcatatcatctacttctgcatcctgtgttatgatacatcttggtctctgtgtttttgttacagttacatttacagaaacgcttcggttacttccatccatcgtctctgctgtaactttacaggaaccctgtgcaatagcagtaataacccccttattatctactgttgcaacgttattatcagaagttgtatactgtaattttttatttgttgcatttgccggcaatactgtaacagccattgtttcaatattaccctcattgattgttacatcatatttctttacggtaagagctgacactttaattgctgctggcgctttctgggcttttttcttaacagtaatcttctgtcttgcctttaaaactttctttccaacctttgcttttgcagtaattgttgcctgtcctgccttaactcctttaacaacacccttgctatttaccttagcaatacggctgttagaagttctgaaagtaatttttactttcgcttttgcaggctttactgtgacttttaactttttcttcgcgcctacttctagcgttgcctttttcgccatagtaattttctttgccttcactgctgcgtttgtgttaagcattgttaccggcgatgccaaaacagacactgccataataaatgccataaccaatgcggtaacctttcctcttttcattttcctcctccttttgtacagatttgctagttttattgttttttcatcctgtacaattatgaattttaccctctatattgcctgttcgtcaacccattttgataaaacagtgtcaaaaagtctctatttccatgaaattttatataaaactttacacgacctctatttttcttttacacttgataatatatggatttctgatttgtcgggttgagaaaactgacagacgaagtcaaaagacgaaatactgctcagatgtggcctgggagttgcgagactataacataatattagaaaagctctgtatgaaaagttattgattttgacacctttgtgttttgtacaactgagtcaaaatcaataacttttcatacagagcttttcctagagcgtctaccttgcctgcggcaattatttacctgacaacttctcatcaattgctgcggcagctttctttccagctcccatagcaaggattacagtagcggcacctgttacagtgtctccaccagcgtaaacgttctctttggaggattccatagtctcttcgtttacgatgattccgccccacttctggcactcaagacctggtgttgtatggcggattaatgggttagggctctgtccgatggcgatgattactgtctcaacgtcaaggatatagttagaaccttctattggtacaggacgtcttcttccagatgcatctggctcgccaagttcctgtttgatgatttccattccttttacccagccgttgtcatcaccaacgatcgcagcagggttatttaagaacttgaagatgattccctcttcttttgcatgatgaagctcttctaaacgggcaggagcttcttcctcgctacggcgatatacgatgtaaacttcttctgcaccaagacgttttgctgttcttgctgcatccatagctacgttaccagcacctactacggctactctctttccaacctttactggtgttggaacttctgggaacttgtaacctttcataaggtttacacgagtgaggaactcattggctgagtatacaccgagtaagttctcgcctggaatatttaagaatcttggcagaccagcaccgcttcctacgaatactgcttcataaccgtcttccatcagttcatcgattgttacggaacgaccaacgattacgttagtctcgatatctacaccaaggtcttctacgctcttgatttctcttgcaactaatgccttaggcagacggaattctggaataccgtagcttaatacaccaccagctttatgtaatgcttcaaatacagtaacatcgtagccttttttgataagctctccggcacaagtgattccggatggaccagaacctacgactgcaaccttctttccattcttcttaatgtctgccttgactggctcagcatgttccatatgataatccgcaacgaatctttccatacgtccgataccaacaggctgtcccttgataccacggacacatttaccctcacactggttctcctgtggacatacacgtccgcagattgcaggaagtgcgttctcacttgtgataatctcataagcagcctcaaagtctccttctgctaccttttcgataaatccagggattggtacgtttactggacatccacttacacaaggtttattcttacagtttaaacatcttgctgcctcttccattgccatctcagcagtgtaaccaagagcaacttcctcaaagtttttatttcttacatctggtgcctgttccggcattggaacctttgtcagactcatatttttctttgccattatgcttctcctcccagtgccatcattttacattcgtgttcttcttccttaaacattccctgacgtttcatacattcgtcaaagtctacaaggaatccgtcgaagtccggtccatctacgcaggcgaatttagtttctccgccaattgtaacacgacatccgccgcacattcctgttccatcaatcatgatagggtttaaggataccatggtatgaagatcagcaggctttgtaacttttacaacattcttcatcatgatcagcggtccgatagcgatacattcatcatatacttcacctttatctaaaagatcctgaagaacagtcgtaacgaatccttttgttccttcgcttccgtcatcagttgctacatatacgttctcgcagaattcacggaacttatcagcccataaaacatactctttgctcttaccaccaatgataacgtcaacttttgttccgttctctgctaatttacgaagctgtggatataaaggagcagctccaacaccaccagcaacaccgatgactttgttctctttcttttcaagggcagcaggcactccaagaggtcctacgaaatctgctacatactcgccttcttttttctggcttaacagagttgttgaatatcccaatacctgataaataatagtaacagtctctttttctctgtcataatctgcgatagtaagcggcactctctcaccatcttcatctacacgaagaatgataaactgacctggctcacatttgcgcgctacgaaaggagcataaatctccatcagctctacaacgctgttgagcgtttctttttttacaattttgtacatacggttacacctcactcataatctcgccaaacaagtaactaaatttcagcgtgtttttattattgcacgaacagacaaaaagcgcaagtaaaaaccgcaaaaagtaagtgtttctgcggcttttacgatttcgttctgtcatgaatataacgataaaatcctaacaaaatctgatattatcaaaccttattttttcggtttataggaactcttaagagaaacgatccgattaaatataagatgttcctcgctgctgtccttcgcgtcacagcagaaatagccctgtcttacaaattggaaactgtcataagccttgctgtcttttaaacctgcttctaatttacatcccggaagaatagtaagggaatttggatttaagttaagacttccatcctcattataaacacctttttcttcatccacaatattctcatataatcttacttctgcatctacacattcatctgcgcatacccaatgaacggttccctttactttacgtccggtaaatccgcttccgctctttgtctctggatcgtaagtacagtgaatctctgttactttgccattctcatctgtaatataatctgtacatgttacaaaatatgcgttcataagacgaacttcgttacctgggtaaagacggaaatactttttaggaggatcaatcataaagtcatctctctcgatataaatttcacggccaaaagctactttacggcttcctaattcctcattctccctgttattctctacatccaggtattcaatctgtccttccggatagtttgtaataacaaccttaaccgggtcaagaactgccatcacacgggactttttaagctttaagtcatcgcggatacagaactctaacatcgcataatctacagaactctgtgctttggatacaccggcaagttcgatgaagttacgaatcgcctctggtgtgaatcctcttcttctaagagctgcgatagatacaagacgtgggtcatcccatccgtctacgataccgtcttctactaacttcttaatgtaacgcttacctgtgattacattggtaagatacatctttgcaaactcaatctgtcttggaggctgttcaaaaccaacttcctttacaacccagtcataaagtggtctatggtcttcaaattccagtgtacagatagaatgtgttacaccctcaatcgcatcttcaattggatgagcgaagtcatacattgggtaaatgcaccacttatctcctgtattatgatgtgtcatatgtgccacacgataaagaatcggatctctcatattgatgtttccggctgccatgtcaatcttagcacgaagaaccttttcgccatcagcaaactctccattcttcatcttctcaaaaagctctaagttctcctctacagaacgattgcggtaaggactttcctttccaggttcttttaaagttcctctgtactcacgaatttcttctgcggataaatcacagacataggccttaccctttttaataagagtaactgctgcttcatacatctggtcaaagtaatttgaagcaaagaacagtctgtcttcgtagtctgcacccagccactctacatctttcttaatagattctacgaattctactttttcctttgtagggtttgtatcgtcaaaccgaagattgaacttaccattgtacttttgtgccagtccatagtttaataaaatagacttcgcatgtccaatatgaagatatccattcggttctggagggaatctggtcataacatggtcatagacaccctcttctaaatccttgtcaatcgccatctctataaaatttttcgatactttttctttttcttccattctcatcctcctgtaactctatatgcatcatcaaaatctcctgtaccctggagcgtgtttaaaaaatgctctaatgccggcacattaaaatttctgaaatacattctataaaggcttctctttccttcacctgcgttctatcatatcatacttatttttcctgtacaagtaaaaatcaacgctcttattttttattctgctccttatcatgttctttataaaaataagtattatctcctatctgcccatatttcttataaccttttaactttttataggcggaagagcgaaaatataatatatatgaaggaagatttctttttttccctgaaagcgcatcatctactgcctgtatacattctttggaaggcacacggtcaagatatggatacgtctccgtttttttgtcataatatgcactaaattgagccttttccgttattacctccatcaaatcatccggatatttgtcagattctaaacggtttaacatacagctaatcactgctaaagagccctcataatctgtgtcacactccatagaaactactttataaagaatttggcggtctccggcacttatgacattatcatattttaccggaaccgccatcgcttcctttacattttctttatctttctttttttcttttgtctgatttacattttttcttccattttcctgctgaagttccaaaaagctgtgtccttcaaacgaaagccagtcatccgccacaaatggaaaaagcatttgtgatgcactcacattctgaaaccagaaaaaccaaagtcccagaaacaatataacatagccgtaatttcttttcctttttctattcatattttctgctcccgtcttattatttccgcattattgtccttaataatatatgacagaaagccaaaaaatatgatgcccagagtcaaaatatcaaaataccttctcatttgcaaaataaggtattaaaatatagaactcccggcattcttgctgagagatgcgcatcatgtaatgcatgacatacttcttctgcgcatctcacatctgatataaaatatttattatggatttactaaaatataaccgcctgcactagatacactcttataataaacacttgtagatacactcttacaaggaatcatatattttacaagctccttcattgtagtgaacttaattctctgttttttaccagaccattttcttgttgcagaatctgccacaataaccttccctgtatttgtcataccaagaagtaccattgtatgtttcgaagatgaccacttatttgtgtaagaaccaaatcttccattcttttgtgtacgattgttcacttcaataataacaggattaccagtttttagatgtttttcaatctgccttactgctgttttatccttgaaaaaacgaatatatctgttagagatattacaataacttaacactttagaaataccgtaaagagaaaccggacgctgtgctccaagagactttctgtagttcgcattccatctgctgctcccaaaaaccttcttctctaaaattctagatgtcttattcggtgtataatttctatattttttgctgtatcctgataaaacagttgtcagagaacataccgcacatccatgtaaagaaataaaagaattcttcttatacttcttacttgtctgtgcaaatacacgatatgttctctcaccattcccgctctgtacagttgctttatagatatctaccttcgtattctttgaaatagttgattttttcgttacgatctcctgtgcagacacattcattcctacagaagaaagcaacaacactccggccagaacaaatgccattatttttctagataaattcatttttcttttactctgttttttcccaaaaaacatataatcctcctttttgtttttatatactctcaaaatcttcgcacataatcaaatgtatgaaagcttatgaacgcacaccttaaagcgtgtaaaattcctacttaacaaatgaaacatacattttacatacccggccattataacacagcatttattctgtgaaaagagaattctataattgtttgtatttttcgaaaatttagcaaaattcagttgacaaacatatgttatcatgatagaatgctttttgtcaggtttgtacatctgaattgctgatgtagctcagtcggtagagcgtcgccttggtaaggcggaggtctcgagttcaagtctcgtcatcagcttgttagtataaacgaaaatgaaaagagaattatctaactatatgcttcttatcgctgcactaaaatgttcagtcgcattttaagcttgttctaagacgcatatattagataattctctttttattttctatttatgttatgggaagatttaggaatgggagaattttggcttctacttgctcttgaggtaaatagagcacttccgacttatctccctttctccttaaagagaaactagaatcacacagccagccaaagacagaaaatgaactgccagcagctcctatctgcgacctcgaaaccgcagatatatagcctgtgaaaagaaaatcgccttatgaaaaagtattgattttgcgacttttgtgttttttacaatggagtcaaaatcaatactttttcatcaaagacttcttctcaccgcgactaaagtcacagataggggccgtttctagagtgtgtttcgtccattgattctattatcagtttctcttatacaataccttcatgaagtcaatgtaattttctgattgtgtgattttttctatcatctcatcattttttacgagtgacatgatttcatcatatacacaaaccaaacgattctcatccctgatttcttctgggagcgccaaaaggaatataatctgtatgttatcctccttataaggcattggtcttcgaaatactcctacagataaaacaatgctgtctcctgctttttgtacggcatgtggaattgcaatgttatctatagtcatgctcgaacgggattctttttcccatacccgttctttaaaatctgcatctacataacctcttttttcaagagtgtctattatatagtttaatgcggaagtatagtcttcctgttctgataaattaaagaaagtatcttcttttaaaatatttgccatgacataccagttatcatctaagattgcagcatctgttcctttacaaaactttgcctgtcgaagcttattttttaattcattttcatcaaaaatctcatggatatagatgactgggcattcgcactctatgatgtgttcggttgtgcaaatgacaatatcatactggtcaagtattccgcttaccgcttctgacggtgaaagaatgtcaagctggctgctactgtctactaccttacgaatctgtacggcaaataattgtgcagtcactcttcccttatcactgataaccgctattttctgttgcttctgatttaacgtatttacttctaaaaatacgccaaaataagcagcgaggtatcccatctctgcctgtgtgacaacaacttctgcatcttctttaatcactctggctgctatttctgccattttaaatgccagcggatatttatagtgaatatcctcaaacattggattatcgatatgtacattatagcggagccgattaatcataaacatgatatgatacatgaatttttctgtaaattcgtgcgtatcaatcgaaatatttaattcctgacgaatctgttctacaatcttttgtaataacggacgaatcttttcatctagttcgatgctgtacatatttttactgtccgccggagtgcgcattccgataattggaagaaaaacaaatattttctcctctataggaatctcaatgtaaaattcttttgaaatatcgtcaattaattcatccacgaatgaaaaactgtttctcgataccagattatagtatttttccggcatacgggtaatgacatgccccgttaaaaaccggtcaaacatcagtgtcatatagttttcaaacattttctgcgtggattcctcaaaattcttttccgccattgcttcacgaattttccctaacatcagctcatcttgtggataattctgataaatagagccaaaaagattctccatcacaaactttcggatatttagctctgaaccgccaagtgcaagtcccttactggtcttacctacaatttcaagttcatatttctccattgtctggcgaagctttttcaaatcactgattagcgtacttcgccctatattcatctcataggcaatatcatcggtaagcactggttccattgccctcataagcttcgcaaaaacatactcctgcctcttctgtgaagagttcatcaaatcatctgtctcaataatacgggcatatgcattctgaaaatctctggtatcaaatacccggagactgcatttaccctgattaatctcaaccagaccactgtttttcaattctctgttaatatctttaatatcatttcgaactgtacgctcactcaccccaaaccgctgtgcaagcatctcaatattcaatgcagaattttttcgcaaaacagacagaatgttagcctgcctgttatcaccaaataaatttttcatacctcatccattatccttttcagattttttagatttatccagaatactgcctcactaatatttaatctcacaagagaggaaaagagttatatctgagatatatcaaatattaatgggacagtatatctgttttgtattcactttttaggtagctatccagagcatttttcaaacacgctctggaatctattcacaaaatatcgctttcataattctgatattccgaatagcttataaatttattctataatctgaatcgttgtaccaactttaatttccggaactgctttttcttctacataaagagttccaggaagctctgcttctgtcattccgttaaaacggatagtacaatgaccaagacctgcgagtgttaccggcgcttcttctcctacgcaggtaatcttatattcattttcatcaatctttaatgtctgtcctgctttgatttctccattgattggattcacatctacagaatagcaataatctctaagttctgccggagcgctgtctccaaaaataataatgaagtctcctccgttcatcatcataatatcttttccaagttcttttactttattctcataaattacagccatgatttttctgtcctttctacactttgctccctttacattgtaacacattctccaatacattacagagctaatttttacattttttctattacaatcttctttatcgtttcatttgcagcctcatctacatacttatttataaatcttatttgtaaactttctttgcaaattttctttactataaattttttactataccaaaatagtttttctttttaacttcccagaaggcgtttgaaaaatgctttctgcaagatgtgcagattgcaggaatgatttttcaaacacgctctaatgtacttttggaactttcccacaaaatcaattgtgagaaagattcccgaaatacatcttatattctcttcttaccctacttatgcatataatccaaagcttgctgcatacgcgatcaatactcgaatccagcctgttaagaatctggaatacataacggaaagtacaccaacttcgatggtttcaggctctgcttccgcaagtccaagacctaccgggataaagtcacatgcgccttgacagttgattgcgaaaagggctggaagtgcaagctgtggagcgattgttccctttccaatttctgttccgattaatgttccgacaatctgtgcgataacggcacctggtccaagtaaagcggataaacctgggatagaacagattacaccaagagcaaccagtccaaaaacatttcctgctaatggagttaacagtttggcaaatgcgttaccaaaaccagaaccattaatgatacctacaagtaaagatacaaatgccatgaatggaagaagtgttgtgatacatgtctgaatggcatcacggcctgcctgataaaaggtatttacaaacttaccaacacctaaacctacttttgtgatgatagatttgttttcctgtgccgcaagtgtttctgatactttctgatctgcattaaatttcactgctttttcttcttttttctcggaaacttctgtagcctgcactgcctctccctcttctgcaagagaaatctgtttagaagtaactgcagatacataaatatcttctgtaataaaattagcaagtggaccagatttaccaactggcattacatttaccgtaggaattcttttttgtggataaataccacagcgaagtgttccaccacagtctacaataaccatggcaagttcttcttctggtgcagaaccgtggaagccatctaccggtgtcataccactgagttctacgatttttttaagacattctggtgcagttccaccaccagtaatgtacataactttatttttctgttctgttggacgaataataagtggaccaccaaatccctgcggacctctttcaatcctgattgctcttaattctgacatttccgttcctccctctatcgtttcctttaattttctgatatttttaatgtacggctaagttttacaccctgctgtttttctacatatcttgttgtaaactctgttacccatccggaaataaagtttgctacaagaccaactaaaagataacgtactgctaaaggtgttgtatctaattttaaagtagagattccatttgcaattccaagccatacaaaaagttcagatgcattaatatgtgggaaaataccgttgtttgtatgacagtgatatgtagcggaggcatagtatgctggtttataaaattctggcatgaatttacccatggaaagagccattgggttacctaacataaatgcagatacaaatggaagtacaagataacgaagaatcggattcttggtacatactcttgcaagtttatttacagattcatcacctgctaatgcgatgatcgcattcattaataataacagcatcaggactgttggaataattcctgtaacccagcttacaaactgttctccacctaaggtaaaaagattcataaatcctgaagccaatttaactaaaatattcatagttacctccctctttacgctcctgcgcgtcgattaaatagatttgttaccacattgcctgctttctggaaattagaaggaggctgcgctatctcttcccctgccatgtattttttataggttagtgctgcgtcctctacggcttttctcagattcttatgacttttttctacatcatttgcagataaatctccaacataacgtccttcaaatcccggaaaatcttttactctggcaagaaatgtcgttccttctatctttctcgattcctgaataatccccttttcatctatgcgaaacattacgattgcccctgcatggaatcctcccgactttctgccaattgcgaccttgcccttccgtcttaaccgaacaaattcattgttgaaattcttcatctgaaaactgcttaacacaaactggatgacaaatgccaatccaattacaagtgctatttttatcatagcgaacctccttctctcttccctttccataaatatgtttccgggaaatctactgtaaagacagctacagcagatattcccctgagcttgtttaaaaaatgctctgatacatattatgtcaagcagattatcctctggattttcctccagaaatgttaactgttgttcctgtgatgtagcttgcctgatccgatacgaggtatgctacaagacttcctacttcatcaagctttccgtctcttccgattggaattactttactgtaatctgtggataaatcttctggttttacccctcttgtatatgctaaagcttcattgtaagctgtggtacgaagacctgttgcttccatgattcccggtgcacatgcaacaactcgtacattgtactttccaagttcctttgcccaggaacgagtgaagctgtctacagcaccctttgtagcagaatatgctgactgtccttgagaaccttcttttccagattcactggacatatttaagataactccatgtccctgttttacaagttctcttgcaactgcctgtgcacagagaaaaacaccttttacattaactgcgaacatctttccaaaagaatcttcatttaactcgtattctggcttttctccctttacatcaacaagtaatcttggaagattaattcctgcattatttactaatgcatcaatctttccatatttttcaagaacggcctgcaccatctggtttacgctttctgggtctgtaacattacactgtacacagtaagcgccgtcaagttcatctcctgtttttacattaaggtcaacggcaactgcatttgccccaacctttacaagagtatctactacatgttttccgataccggaagcaccacctgttacaataaccacctgtccgtctaatcccagccaattttcattcatcatgtaatcctcctttttaaatatacttttcaaatctttcctgtctgatttttaagtacttaagcacttttgatttacaatgccattatagtaaggattacccgcttttttaatacgtgctttttcggcctttctgaaaattaattatatgccagatttccttatttgtgaaaaggtttagtacagtggatttcctgttttttgaaaagcgttagtgtggagaatttcccaaacagggaaaaagggctgattaatgatttggagcaactaatagacgaagtcattgcccctaataaggcatatttgtgattttagtcatggcgcgttgaatgttcgctttatgcgctcgcatccaacacttgctccgagaccacaaatatgccttattaggggcaatgacttctgtgctgtgaatggaaaaggtgaattaaacagctggtgggcagtttgaaactgaaacttttatcttctctataaatgcgccttagcaaatgatggatgtagtcgagcattcatcatgcagtgatacgaagcatttattatacaatgcccttttgtcatggttgtctgtttatccttaactcagtttttcttttaaaatctccaatgtttcttcaattcccttatcaccttcgtctatgatcaagtcagcatatttctcgtagagtacgcttctctcttcgaaaaggtcaagtaaagtctgaccatcttttaaggctacgcctcttccttttaaatctccaagtcgtttggatagaatctcatatgggcaacgaagataaattatctggcaggtatctttgtaatgaagcattgcttcttcacaatatactgcacttccacctgtagcgatgacagaatgctttgcattgacttcgcggtttacctggttctctactgcaaggaatccatcatgtccctttgttgcgataatatcttttaacagcattccttcctgttcctgaatgagaaggtctgcatcaaggaactgataacctatctcttttgctaaaataacaccaattgtactttttcctacaccgggcatcccgattaaaacgatactttttccgtctttcataaattgctccttatatatcttattaatcttcttaaaattcacttcgcagagcatttcacttatcatttggtttcaattcacagtcagtaaatcacatggaagcctgtcaaaccttaaatgccgacctaaatttaacttcatatcagtaaaatttacttactatttatcccaaaatattctaaagaaaaactattttctgcttacttatggtttgcatactttacaagcttcgtagccttcttttattaaaatatctctgctttttgaagatatgaccttgttctcctcattcatctgctttacaaaacggcaggttgaaagatgaaacttgcctgtgtcttcatttataacataggataccttatttttggaagtattttttgctgtactttctgtagtttttttcgatgaagtttttgaggatgccttatctgtagtactctttgctgtagtactctttgctgtagtcttttttgaggaagtcttagaagttgttttacctgcactatccttaacagaacccttttttgaggctgtactccaactagaagaagaaccttttggctcgcctggtgtccatgttgtatctggtgaagcattccatgtaatatcacttccatcactgtaggctacaattgttccctgattatcggtacggaaagtcttaatacctcggcttcggaagttatttaacgtctgtgcggatggatgaccgtacttattcccctcaccacagctaatgacagcatatgcaggactcactttatcaaggaaatcatcgctggaaccagtcttacttccgtgatgggatgctttataaacatcggcagaaaggtcttctcctgtatctatcatatcgtcttctgcctgctttgctgcgtctcctgtaaatagaaaacgattcttaccatattggagcaaaattccaatcgaccagtcattggtatcatccccataatcctttaccggtgcaattatcgtaaatgttgcatctcctaaagaatatgtcttgccaagcttcggagcctgcgctttctggttcttagactttaatgcctgcacaacatcatcatatgtcttcgtatccgaggtgacatccggcataaagacctttttacaatcaaacttataaacaacaacatcaagcccgccgatatgatccgcatcaggatgggtacctatagcgtagtcaatcttctccacattttgactatctagataagactgtaccgctgttccttcgctgttgtctcctgcatcaataagcatcgcatggcctccgacctttattaaggtagagtccccctgtcccacatcaataaaatgtacctccataccagaaccattctggcttatcttaccatccgtttcatctccgcttcctgaaattgcaacagaactgccctcactgcatcctgccatacagaatgcaagtaataatgataacaaaagtatttttatctttctcatcttcgtcctcctcttacaaacatatgtttgtatattatcatatcgtattttgaagcaaaggtcaatagcattttgccctcttcctatcataccttgccatattttgttttcatatcccctctgtttttattaattttttacaggaacacatcatataaagcgattgtttttttacaaaaaatacgatatgataatatacaattaagaaaggaatgtgtgctatgtttgaaatgtttgctaccattgtagctgcctgtgctgccgctatctatggtctttcacgctcagtttttatgtccggcgtacatcgtaatctttatcgcgccgcatttatcggtattattattcttgtgtatgttacttaccgcatttatcattacatcaagtttaagaatatcaaaaaactgaatgtcgattttgatgattatctttactatgataagtacacctccccactttaccgggcaggatattttatcagttatctcgtacagaatattctctttgactatacatacatgaagagaaactacaacttctgtaaaggtcttgacgtttacgatggtggagtaagcgaatactatatcaagttccgtaatacctggtatcgctatttaaaactcactatgattcgtcatcgcatttctttaaagaaattgcaggcattttcctgtgatatgaagaatgagatgatcattgctgctttaaatacaccagaagaaaaagaaatgcatcaccagtttacaaaagatgctgcggcatattttcaggaacatcagtcttttaacaaaaaagttattgaacagtttgcaaactatgcggagattacaccaatgtttcgaaagaatgtgttaaaacattaccgcgctcttgcttatacggcgaagaaagaacctgagatggtggcgatggtgaagaagcaggaattccgcagagagagggatgttaacgactttaaaaagatgaatttccgataaacggaaatttgtgatttaattcattaagaaacacacagcccgggaagagaaccgatcccctatatttgtgactttagtcgctgcaggttgaatgttcgcttacacgcttgcatccaacctttgctccgaggccacaaatataggggatcggttctcttcccgggctgtctattttctaatgaattaaatagtaaaattattcagcgtaagtatttcttttactttttaatattataatccagataaagttctcattatcaaatctacatccttattttcaagttcttggatgatatgtagatatgttttctgtgtagttgtcatacttgcatgtcccagtcttcgtgctacacttgcaatagatactccagcaaataacaataacgatgcatgcgtatggcgaagaccatgaatagaaatatcggaaatgccacactgtttacaatgtcttgtaaggacatcattaactgtagaattataaatttttgatttacctataaaaataggttcatcttccggtaaaccttttatcaactccgaaaacttgactactatttgccagtcaatctgaatctttcttaccgatgacctgttcttagtcggcaaaaaccctccttctcctttgtaatcccaagttttacttatcgacaaagcctgtctggcaaaatcaaagtcagatggtgtaatcgcaagagcctctgaaaagcgcattcctgtttttgcaactaaaagtataaaccaatcccagtttggttcttctgaaagatctaagctggcaattaacgtatgtaattcaaactggtttaaatattttatctttttggctctcggtgttttccctttaataattgcctttctggtagggtctctttcaatcataccttcatctaatgcatctaaaattgctcctttgagctgatgatgaaaatctaatgtagtctgtctctcatgctctttcgcataatcatttaaaatctgctgatatgctgttcttgtcaactcagaaacttttaattctggtgccagtttctgtatccacttctgagtcattaaatacttcgccattgtagcttctcttatcgcacctttcttatacacatcaacccactgggcgtagtattcataaaagagaggtgaattatttgtgttattaagcataagttccctccatcccttgaaattacttacgctgatacaaacatttaacaatgaacctttttatatacttgctattaacggcttaatttctttctccagtgtctccttcagttccgctatcatccgggaataatatttgaacttaggtaaagctttctcctgctctgccttataactagtataatcaacattctttttaattacactttcattaggaatttcaccgttcctgtaatgcattgccgcatacattacatcacctttcattgcataccagctttcacaaaattcagaaacaactttttctatgcaatcctgcttcatattttctacaatattaagaatagactgtcccttatattttgtttcatctttttcgatttcttctatcaaatcagacataatatctgctactttttcattatccttacgtaattcctctacatactgttttgcttcatctatcttcttctgtctctcttctggtgttatatcttcttcctcttctgttggtgtaacaatattttgaataagattgatgatgtactcataatcaatttttgtattactatatgccatcaattcataatcctgatctacatccgtctcctctatggcagtttctgaatcattcgttttttcttctcgaatttcctccattacatttttataatgtcctacataatcatcatactcttgctcggtaattccatattgttcaagcatactgtcgtcatagtttgtaaaggattttaactgggcaaacagactgtcgaaagattggaacatcttcgcaaaaatcttcttttctttcatagacatttcagggatttccgaaggactctcggcacaaactctgagcgcggaaagggctttgcgaaatgccggttctacctcttcccattgtgctaaaattgcaattcctgtactacctgctgagtataattttactgcattatcaacactttctttaaataatttcggagcttgaaaggttacaatctgcccattgcttttatttttatcaaaaatacgattcgttcttgaaaatgcctgtatcaaatcatgcggtcccattggctgtctgtcaataaaaatagtggacagacaaggtgcatcaaaacctgttaataagcggtctacaacgataaccaaatctaactgttcatttctactcttaaactttgcatcctttctcgccagtcttttgttaaggtttccattatagccctgtatctgtgataattcatatttggtgccaaacattccattataatcatctaaagacttttgcattttctgttggttcacgcaggaaccttcttcattttctgttacagaatatgtaatcgcaaacttaggaaaatccggcaatacctgctttatcttttcatcaatttttaatgaagattccccattttttatttttgtcagtaaatcataatatttctgtgctaattgaatggaacttgttgtaagaagtccctcataagtcttaccttttccattttgaaatcccaatttatgataggatttattaagaataatatcaagcacccgtaacatatgcgtttcattattatatacactgctatctgtttcatctgctacatttttcggaccattatgttccacttgaaaacctaacactgctttatcatgaatcgcattttgtattgtatatttgtgaagacgttctccatacaatttttctgttgttctcggcaaatctcccaactgcggatatggattttctgcaaaccgaggcgttccggtaaaaccataccacaaagaacgtccaaaaaatctttctaattctcttttcgtctttggtgtaacagctctatgacattcatctacaacaaatgcaatttttaaatttttaattttctgatattccggtgtatcttcctttagccttttactaattaaaatctgcattttctgaatcgttgtaacaataacctgcctatcttcagattttagctttttctttaaatcattcacattatcggtctcatcaacatccaccaaatcattatttgcatatgcctgaaaagccattgttgtctgtgtatctaaatcttttcggtcaatcaaaaaaattgctttatcaattgccggaatatccatcaataaatttctggttgctttataagaagttaatgtcttccctgatccagtcgtatgccatacataaccagaccttcccgtttttgaagcctcccttatagattcaattgcatgaatctgatatggacgaagtaaaatcaaccgtttcgcatcttcatctaaaaccgtatatcttgcaatcatttcatgtgcttccggtattctaagtacactttttgcaaaatcaagataatcagatacagaattattctcctgatccacccatccactcataaatttgggatttaattccgtatccccggccgccgcaaaatatctggtatctacgccattgctgacaacaaacatctgcaccgctgaaaaaataccggtaaacttaccttctccaatatactttctaatctgccagaatccatctatataagaatgctgcttattcttcaattctatatgtatcaatggaagtccattaatcatcaacgtcacatcaaaacgtctgtctcttgttgatgctgcagtatcttcttccgtttttaacgcactgtactgattaatcacctcatatacactacttccacctgctatatgttcatgattcatgactacaagatgtaatctttccgtatctctttgcacatgtacctgtacttttccgttttcaccaaccagccattctccagccttataaaaggaagaaaactgtaattggtttttaacctgttcaaattctgaatccgagagcagttctccattcaatctgtctttattattttgctcaagaatatatttaaaatttgcccataaatccgcttccgtttttaaatcttctctgtaagtccactgggactctccgtagactaattgttctatcagttttctttctattgttgattctaattctggcatttggtaatcccccgtaataatattctatttctatcctctttcttagaaaccaccattttgatatgctcttgcaatcacataagatggttcgtaaaaagcactgcaattataattatcaatcacatcgcaaatttcatcattataaacccaaaggattccctctgtaaaatcctcttttctagaaagtgtatctgcaatcaatctttgatatacttctcccatatccaacgaagtcggaataagcgttgctaattctgaatcgacatttgtaatgtcaaaacttccttctacaagtccataatctctaatccaatccgcttccaccttttctagattctcacaatgcaacgtgctggcacagctaagtaagtgatataattcatctttccctatagcattcaccacatatttattcttctgcttaatatgtctggccacacgttcaatcatataacaaataaaatataagtcattcatagttatatcttcgtctggaaaatatttgtttttcataatgtatttcttcctttaaatcttcctttttaggctgaattttatcttttttctataaaaacatattttttagcatgtattttcttataatttgtagttgattgcacttgcgctggtgaagagtgatgaggttatcgatgttgcggaaatatgttcctattttggtctgctcttcctttttgggaactttaatttcaaattctgcatattcctgtgcatttactccgggctgtccagaacgttgagaagtcacagcaatatacttgttatatctgtctgtcaaggtattctgaaatacaaattccgtgtcatattcttctttaattcttgctcgaatcaagaagcctgcatagtaaactaatccatcagaattcttgtaaatataagattttccgacacttgcacctgttcttgcaaatagaatatctccttcagttagtttataattatctgcaccagttaactcaatatccggggaagtaagattgtctgttaaaaactcatgtgtgttatcgtcaatatctgtaattctaatatatttattttctccatcatattctttcgctgctgcattcaatccatattcaaaagacgatgcaagttcacccaacttacgctgttcccaatcttccgtataccccttaaatcttatcttcgtctttcccattttctcacctctccatctttttaaccagttcatttaacgatgccattatcttctcatctgatgatgtcagctcttttaaaagagataaaaactctccttctgcctgttcgatttctttgttcgtctgttccatttcttttaaaacttcattcaggtcaatttctggttctttttcaaatgtatctacatagcgaggaatgttaaggttaaagtcgttcttttcgatatcttcaaagcttgcaaggaaggattctttttctactgtttctctcttactatataaatccatcacagcttcaatatgctcgtctgtcatttcgttctgttttttgcctttattgaactttttagatgcatcaataaataatacatctcttccatctctatgttttttcaatacaataatacaagtcggaatagaggtgttgtagaaaaggtttgccggaagaccaattactgcatagatgttgccggaacgcagtaatttttctctgatttttccctctgccgctcctctgaatagtactccatgagggagaacgattgccattgttccattattttttaaatgataaagtccatgaagcaagaacgcataatctgcctttgattttggtgccagcacaccataatcactgaatctttcatcctgtaaaaacccggctgctgcgctccattttgcagaatatggaggattcataagtaccatattaaagtctgtttcttctcctgtaggccagtctccatctaaggtatcaccatttcgaagcttctgattttctgcaacgattccatgcaaaaacatattcattcttgccagattataagttgatgtatttaattcctgtccataatatctaatatattcaggatattttacatattttttagcattcagaagaagggaacccgatcccatacatggatcatacacagataaccctttcttttcttcttgtccatcaattgcaatcttcgttaaaattttagatactgcctgtggagtatagaactctcctgcctttttacccgtttctgatgcaaactgaccaatcaagtattcgtaagcatttccaagaatctctgcatctgaatttaataaatctgctttatcaatttccttgatcaaattggcaactgtatcactctgtttctggtctcctgttcccaaacgattcgaatacaaatcaatatccgtaaacaaatctgcaaatataggatcactttgttcaatattattaaaagctttttgtaactgctctcggttaaaggaattatttcttgccgcatctgcaaaacaagtataggtaagttccggttcgatcacataatgacattcctgtttcatttctgcctttaactcttccccatcttcgctctgtaatacttcttcataagcttccagagcttcctttaaagttcccggtttgccatcacaaatcatatcgtatactttaatcagaaaagaatctgataaatatttataaaaaacgattcctaacaaataatccttatattcatttgcatccatcttcgaacgaagaatatccgctccactccataatacactaatcaaatctttgctgttttctatctcagccatttttctttatcctccgctctttttcctttcatcaccattggcctgatgatttataactatttagacccatacagttttcgatatattttacgcaatgattctaaatacttacgatgatttacagtaaaagtataccatattcaaaaaaaattgatatatagaaaacctcaccacaggactactcctgcagtgaggtcttacaatcttcgtaatatattcaattcatctattgagggatatcgtttatatattttttcaatccatcttcgttgaaaaatcatactcttcatttttctcaatataatatgacacaatatcccctaccaaaataatttcattagaaagaatattatccatattactcatcttcccctatgtttttcctttttcttttcctgtcttaactgaaactgatattccgcttccgcctgtttttgcttcctgctttttattttgcgttcctgcttattctgctcttgctgtagtttaagtgcctgctgtgactttgttccaatcccggtattacgtaattgtttttttacttctctctgtctcctctttggattctgttttacctccttaataacggttgttaccgacgggctaaattgcaaatcatagtagtgttttaataagaactcgtacacttcataatcctttggttcagtaccaaatgttacttttgatacagatagtttctttccttgaactttctcgaaaacacctacccagaatggttcctcaaaatacactgtcaatttgtcacttactttgttcataaatcttccctcctgaaatgaaaattaataaatgaacaaagaacggacaacccggaggggcaggttacttaccacatttttttgtgacggccgggctacctaccggctctggtatatatttttatatacgttgcgtttttatctctgtttttatacttttaaaattgttacttccactatatctcagcctgcactatatgacccaaattcagttcatcgcaaaaaaggtcatatacatacgatgaactttcacaatacaagccggtttccttatcctgaagcttttcaaacacttcagaattataaaacttattcattgcctcatcatattctaatccctgttcttcagtaatcatatctacaatgtccaaaattatatattcaatcaactggtcttgcttactctataatctcattttcatactggcgaaataataatgccatattatcatcctcctaaacaaatcctataaaatatagtatatcataatctcaaaaaaattaatataccagcacgaatctcaactcctattaatccattaaacagacaatagaattctaaaaaactcttattcactcacaaccatttcataataaacaaaaacttcaactttcatccccaaatcatcccagcttctgctttaattcccccatccagccacagccagccctcgaagaaaaaaacaccctatatttgtggcctcggagcaaggtttgaatgcgagcgcataaagcgagcattcaaaccgccgcgactaaagtcacaaatataggatatcttttttcttcgagggtgtctgtctgtcatcgaattaaaccagaactactcagaactatttccccattctctgtctcacgatttcaaaggcaagtactcccgttgctacagaagcattcagggaatcaatatctcccttcatcgggatagaagcaatgtagtcgcacttttctttgacaaggcggcttacaccatttccttcgtttccgatgataagaccgatagaaccagtaagatttaagtcatacatgagttctccacccatgtcaccgcagacaaaccacatacctttgtccttgagttcatcaattgttctggaaaggtttgttacgcgagctactggtgtgtagtttaatgcaccggcagatacttttgcaacagtactggtaagtcctactgcacgtctttttggaatgattacgccgtgtgcgcctgcgaggtttgcggtacggataatcgctcctaggttatgtgggtcttcgatttcatcgcagagaatgaagaatggagcttctcctttttcttctgcttttttgaataaatcttctacggttgcatattcgtaagcggctgcgattgcaacaacaccctgatgcttttcgtgaaaagataaagagtctaatttttctttggagacaaacttgattaatgtatctctctttctggcttcgcgaaggatcgacttaatcggaccatcctggcagccatctaaaatgaataatttatcaattgttttgccggagcggtatgcttccattaccgcattacgtccgacaacggtacactcttcgtatgccatatttttcctcatttctatcttttaattataaattatctgcatccgacagacaaattcggattaattcctctaaccgctccatctgtccggaaagatataaatatcccattaatgcttcaaatccagtggcgatatgataatcgtggctggactgattctttgcaggtgatggagatttcgcattctttccgcggcgaaaaactgccttttcctcatcggtaagtaaaggcttgattttctccatcatcgctgtctgtgccgccgcattaacgtagctgatcgttttctggtgataatggtttgccttatcgtttccctttgtcacaaccattgtgcggacaaacagttcataaatacagtccccgatataggcaagccccagggatgagtatccccgaagctctttttctgttaatggaaaatgttctgcaattccttttaagcacgtttccatttgacacctgctcttgtatcttcaagaatgattcctttatctgctaataaatcacggatttcatcggcgcgggcaaagttctttgcctttcttgctgcctgtctttcctcaatcaatgcttcaatatcatcatcaagaagttcttcttttttctctgtgataataccaagaatatcgcaaagctgtacgattatgtcaagaagctgctgtgcatatgctttgcttccgctttctgctgtaacgttagcaagttttacaagttcaaagattgcagcgattgcatcggctgtgttgaagtcatcttccatagctgcttcatatttcgcttttaatgcatttgcctcttctaagttcttctgatcttctacgttaagttctccttctggagctgctgcgatcacttcccttaaatggtcaattgctgtgaggattctctcaagaccattcttagaagcttctactaacgtatcgctgaagtttaatggacttctatagtgtgcacttaacatgaagaaacggataacctgtaatggatacttttcactgatttctcttacagtaaagaagtttccggcagatttggacattttcttattatcaatatttaagaatgcattatgcatccagtaatttgcaaacttttcatcgttgcatgcttcgctctgtgcgatttcattctcatgatgaggaaatactaagtcctctccgcctgcatgaatgtcgattgtatcaccaatgtacttcttagacatttcagaacattcgatatgccagcctggacgtccttcaccccatggagatacccatgcaggttcgccctctttctttggcttccataatacgaaatccatcgcatcttctttctcatcacttactgcgatacggattcctgctctcatatcatcaagattcttcttagaaagctgtccgtaatttttaaacttacgagtacggaaatatacagtgccgttcttctcataagcataacctttttcaattaatgtagaaatcatggcaatcattccgtcaatttcttcggttgcttttggattatgtgtggcaggctcgatattaagcccctccatatcttttttacactctgcaataaaacgttctgaaatctcagatgcaggaacgccctcttcgtttgcttttttaataattttatcatcaacatctgtaaagttagaaacgtaatttacatcgtatcccttatattcgaaatatcttcttaccgtatcaaacacgatcattggtctggcattaccgatatgaatgtagttatataccgtaggtccacaaacatacattccaacctttccctcatgtactggaacgaattcttccttctgtttggtaagtgtattatacagcttcatgttattcctcctttatcaatgaaaaagctccgtctccccggagagacgaagccttccgccgtctttattcacgtactttttagtctattcaatttccctgcttttgtcaataataaatcaaaaaaatgttagctatctaatattattattcgcatcttttaatcgtaagtgaactcattttacaggaataatccttttcagtgacatgctcccaccacttaaatcatagattttgaagtgggggcttcttgctcaatggctctactgagccaagtatctacaaactatcctcgcgtgccccgcgattcttttgcccggatacgggcatatttcttattatcagcttgtccggatacggacagtttatgctgtcaacatccttcttgcctcttcacgtatgttgattgctgcattacaatctctgtccatcttatttccacacacacagtgataaactctttcggataatttcagctctttctttacccttccacatttacagcattttttactggaaggaaagaaacggtctacctttaccattttcttccctttccacgccagcttatagtctaacatttccctgaacattccatatccattatcctgtacgctttttccgaaatgcaggcactgacccattgctttcatatcgatatcttccactgcagccgcatcataaccgtctgcaatctttcggctaagtttgtgtagatgatctcttcgctgatttcgtatcttttcatgacatctggcaactttctttttctgcagttcataattatgacttccccgtacgcatcttgacaactttcgctgttccctcgccagtcttttttcattttttctaaaaaatcctgcttcttccgtctcaaccttttctgaaaacactgccattccctgcattgcataatcaatcccaagtatctttgcagtactgtaatccggtccagcagcttggttttcacagctgtatccttcataaagcaggcttgcaaagtattttccggatgattccatactgactgtcactgatttcaggcgaaggccttctgctggctccctgtgttttttcatggcgatccattttaatttaggaagccggatccgcttactttccaccaggatatttccattgaccacattcgttgtatagctgtttttggaatgatgttttgtcttaaaccttggaaatccaatcttgggatcccgaaaaaaattcttataggccttttccagatgaagctggacatttgctagcgccagcgaatctatttccttcagaaatggatattcctttttatacatggccggtgtattttttaacattttcttcgtttttgcatactctcgtatcttatcattaagcatctgattatacagaaaacgacaacagccaaatgttttgccaagaagtatcttctgttcttctgtcggataaattcggaaacgatacgctatgttcaatactttttccctccctgggtttcaatgtcttgatggattacttctacccgaacccctcctgctgtcagcagggcagaaactctgactccaaaaggcttctttccaaagcttttccctgatttccggatactcctttttcaatagtctgctactggcactttttcaggcattgataaatttactaagttccgttctcgactgtgcatggaacattacatacacatgatcaatgtcatgattccattcttccagaataatcccataccctgaagcaatatgttcccatattccttttgccctttctgaaattggattatcaatgacttttcttcgatatctcactaccatgatcagatgatagtacatcagatatactgaatgcacattatgatttatttttccttttctactgactctattataccatggattgcattattgaacaagtgttctctttttatttttacgcaattcatctcccacctgcagaggaaggagaattcttgctatattatgttaaaaatacattcatcagacaatttccataatacaattctcagaaagcgggcaaatgtttttcaaaagcatttttccttcttctgttaaagtttcacagctatcaatactttcttctttcttgccaaaaagatagtctgtaagagccgcaatagaaacgctctgcataccatctgtttttatagtctctgtttttgtgatagaaacctttccatcttttagcgagaaatgatacactccgctctgttcttctaaatacttatcttctatatagatatcttctctataggtatatgcttcacaattatctatttcacagatggtattttcacaattatcagatttacaatcatcgtttccctcactattcgttccacagctgtcggcttcacaaatctttgcttccactttctccttttctgtttcgctggtttcctttagcgtttctattttacattctaaaaacttagaaagttcttctatatttagcagacggaacataatcttcttcaccctttttgctggcataaaacgaaaatttctatataaacctatttttgttgtgatatctttccaggacgggtcaagtataagctgatatcggttatagtgatatttctcttcacaatataaaataacctgctctaaaaagttttccctcttagaagcatctgcacaaaacacctgcgaaagaacaaaatagctgtcctctgctcctactgcagctctgccaacataagattccccatcaaaaacatagagcacctgtccgtaatcactctccacctctttttccattcttcggatataagggacagaaatttctatgaaaatgtcaaacagggtatctttaatcacattttcctgtgcaacaagtgtttcaagttctgcatcggaaagttctgttttaaaggtatatttttcaaatgaagattctcttttgtttttattatctcctaatatatcctcttttatcggacattcttctggctggctttcctgttctacttcttctttctttaataagacttctttattttttgcatcactttcctgttttgcatcaatactatctttcgaatctttttctattatatctttcgcttgtttttcagtctccttacgcagttctggcaaatattccaattcctgctctacctgagccattccaaagcgaaaatcaaatggcagataatagttttcgtctgctggcatcagataagtaaacaactcacctctgctacgaagctcctgaaaagtctttacaaggagttcccgcatcacgccctgtcttctgtactcttcatccgttgccacaccaacgatatacttcgcctctgcttgctgtccttttacatgaagtgtatatggatttaaatgcagcattcccttcacaatgttctcatccgctgacatttcctcattcagcaaaacttcattttttccatatacttcattaaaataaaagttcgcataagatactgggtcatgaaaattatcttcccacatctcataaactctctgctttttcgttccatcatcccagactatcatttctgaatgcctccaaatcttgcacagccgccgcagcctgcacagtctctgtcttccatcaaaacatccgcaccaacataattctgaatctctgaaagcagacaaacagctgacgctgaaataccaagaccttccccggtaaatccgagtccctcttctgtcgttgcctttacattaacctgcccttcctgaatacaaagaactcttgcaatattttttttcatctctggaatgtatggcgcaagcttcggtctttgtgcaatcactgtcgcatcaatattttcaataaaataagccttttcctgtaacagctttccaacctcttcaagaagtttcatactgtccgctccctcatatgcagggtcattatctggaaaatgctttccgatatctccaagtgccgccgctccaagaagtgcatccatcactgcatgaagcagaacatccgcatcagagtgtccaagaagtcccttttcataaggaatctccactccgccaaggattaactttctattttctaccagacgatgtacgtcataaccatttccaattctcacaatgtctcgcctccaaactccgcacatacggatttctattttgttttctatcagtgtaccacattggggaaggggagaaaagtttttcttttgaatttatgaaagacagaaaacgagaaaaggttactatgtgaaaaatgagccttaaatcaaactcaaattgcggtcgagcagtttaagtgcagtgatacgaagcattttcacatagtaaccttttctcgtttgcgtctgtctgccattacaaacaaaaaattgcaataaaaaatagcgggaactggatttgaaccagcgacaccgcgggtatgaaccgcgtgctctagccaactgagctatcccgccatacttaatgttgacaaaaaataagtgggacctacaggacttgaacctgtgaccctctgcttgtaaggcagatgctctcccagctgagctaagatcccacgtcatcaacgaggtttattatactatatggcgtgaaagctgtcaacacttttttacaacattttaaacatttttcttcacttttctttacaaagatatcaagagattttacaatcttttttcttaacaaggcattctttatattttatgcattctactcttccttctcccgatgcatcgccgaaaccaccgccgccaaatgcaacaacaccccatctgaaagtgcagattcttcaacttcaaacttcggatgatgatttggatagcactttcttcccggtgtgccacagcctacgaaggcaaatacacccggcacttccttctgataccaggagaaatcttctccaagcattaatggcgcgatatggacaagctttctattctctaatagctgttccgcttcgtctgcaattcggcgggaaagtgctgcatcgttaagtactggtggatgagagccctgttcataggcaatctttacgtttccgccgtagctgtctgctactgcttctgctcttcttcgaatggcatcctgtaagtgctgtgctacgtcttcagaatagcttcggcaagttccttctaagactgccttaccggaaataatattatactgcgttcccgattttaaggaaccaactgtcacaaccgctccctcaatcgggtcaagctctcttgctacaattgtctgtacattcattacaaagtcagcagccataacggtagcatccacacattgatgtggctttgcggcatgaccaccttttccgatgaaagtgatagtaaaacgatctgtctgtgccattctggctcccggctccacagaaatctctcctgcttttatatcggaaaagagatgcaggccaaacacttcatcaacatcttctaatattccctgggaaataatctgctttgcaccttttgtattttcttcagacggctgaaaaattaatttgacacggacagtcagttcagattccatttcttttaaaatagaagctgctcctaacaagcctgtaatatgaccatcatgtccgcaggcatgcatctttccaggatgctttgactggaatggcaaatctgtatcttctaaaaccctaaggccgtcaatatctgctctaagacctactgtataggcatcatgtggtccaatatatgcagttactcctgttggatctaaacgaagtggatgaatccccatcccggtaagcttctcacagattaattctgttgtttctttttcttcaaatccaagttccggtatctgatgaaattcatgataccaggagataaattcttctcgtttctttgatactttttccaatacttcttcccttgtcatatcaaaccctcttttctgtcctgtttccttctatcatttgctctaattctatctaattgcaaatgtagattacttttttatttttcaaacattctctatcctttacactggattgcaacaacatctttgcctctttccaatacaaaatacaccccgaataaattttccaaaatcacatcgtctaggaattcttgaatattatcctcgaatcaggcgtacaatcaaaactgctgcaataattatcactgcaagcggcaacaatgcccgcaataaaaataatacaatgaaaaataccagtgcggaaataataattgtcataatcatcttaccggcactctgcaaagctcccttctgattgttgttttcgatatctcttctgtcagaatatgcatctccatagctacggtaggaactatcattctgtgcataaccacttccataagaattatctccataatcggaattaccagaagcactttcctctattccgtgcgcatcaataatagagcgggcaataagtcttggacttcctaactcttcaacgacctgttcctcactttttccattacgaatctcatcctcaaaatactgtctgtaatacgttaatgaatcagataattcatatgcagacacttcgccctgcagacattgttctaattccataataaactgttcttttgtcatttctctacctttctttagctgtatatctgtccttgtcctactatctttctttattatctgtttttgcctaatattatctcttcttattacctttttatctatactgcaggtttattcttattatctattttaacacttatttttgttattttaaaatattatattttacgtccttttccgccatataatttgtaatttatcacttatcaatattgaagcttaaaatataacatcgtatagggagtttttcccgcaatctgcatccgtagcgaagaagcgccactatatcgaagaataaactggagattatcatctgaatacgtatcctggtcataatctttcaccataaactgaatactatttggacttttttcctccaaaatatcctcacatttactacgaaaacttttataatcctcacaaagtaaatctttttttctatagtaattatattcgtttccttctgccttttgatacaatgccgcattccatttatggtctgctttcatctgtgtatcatccacattaaaataagtgtacataatacgggaagtctcatccggttccgggtcatcccaggtaaggtctgcatgataccactctttatcaagctttatcaaattccaagcatgtttttctccatctgctgtcccagaaatcatcttacaggtcacaccagaaaggtcacaaagcagcttcatcccctctgcataaccattacataccgctttctttaaaaccagagcaccatatgcactataggcatctccttccggctctttctttccacctggatatccatatgcaacattactcacaatataatcatgaatcagcttttccttttcataatcacttcgcttcttactttgtaaactggtaagaaaacttttacaagcttcatacaaatcccttgctttatctcgttcttctggaatatcctcctcatcaaaaaaggctttttctacataataattatcactaatctcacaatttaacgtcacataagacttattcaaaaactttacactctttatctgatattcctttaccacaccataaaaaccttctatattctgattcagcgtatcaaaatctgtctgatcaagatcacttgtcacaaaagaaatcttcgtctttccactagaaagcgcattttcaatctctgcaagcagttcctttttcgtatcaatcaccgtctgggcagaagcattcagatgtggcatcatactgcagccactgattatgaaaatacttatccagagagttactaacaataatattatctttcttttcataaacacctcatataaataataccttcaaaaatattctaccaacttttaaccaaaaaggcaattctgatttgcgcaggcaaaggagacgctctcagtaaataaaataacctatatttgtgactttagtcgctgcgggttgaatactcgcttacacacgctcgtatccaacccttgcttcgaggccacaaatataggttattttatttactgagagctgtcttttgctgctgaagtaaagtcagaatttatgttttaaaagatttgccagattagaaacagacagccgctgtatatattctatcagattgctcaaaaaatatgaaaaagaagccctaaaaaatttattgaattttttagggcttcttcttaataattcttccggcaatccgattgctatgcttctttagcggcgtctgtttgttttgctacacaaaccagaatttataattacatcattcccattccgccgcctgctggcattgctggagctggtgtatcctctttaatgtctgctactacagactctgttgtaagcaatgtagaagctacgcttgttgcgttctgtaatgcacttcttgttaccttagcagggtcaataattccggattcaaccatgtttacataagtttctgacaacgcatcaaatcctacgcctgcttcgctttctgctactttgttaatgataacagatccttcaagtccagcgtttgctgcgatgtgatataaaggagcctctaatgctttgagaacgatttctgcaccagtcttctcatcacctgtgagttcttttgccatctcttttacagctttagctgcatggatgtaagcagatccaccacctgcgatgataccttcttctactgctgctcttgttgctgctaaagcatcttcaagacgaagttttgcttctttcatttctgtttctgttgctgcaccaacacggataactgcaacaccaccagataatttagctaatctttcctgtaatttttctctgtcgaaatcagatgttgtctcttcaatctgagatttgatctgtcctactcttgctttgattgctgctttatctccagcaccgtcaacgattactgtattctctttttcaactttaacagattttgcacgtccaagcatatccattgtagcatcttttaattcgatgccaacttcttcagatacaactgtaccacctgttaagatagcgatatcttcaagcattgcttttcttctgtcaccatatccaggagcctttacaccaacaacagagaatgttcctcttaacttgttaacgattaatgttgttaatgcctcgccttcgatatcttctgcaatgattaataacttagcgccgctctgtacgatctgctctaataatggaaggatttcctgaatgtttgaaatcttcttatctgtgattaagatatatggatcatctaattcagcaaccattttctccatatctgttgccatgtatgcggaaatgtatccacgatcgaactgcataccttctacaaggtcaagttctgtcttcattgttttggattcttcaattgtgataacgccatcctgagaaaccttctccatagcatctgctactaactggccaacttcctcatcagctgcggaaatggaagcaactttagcaatctgctctttgccgccaacctgctcgctcatgtttccgattgcttctactgctgcatttgttgctttcttcataccttttcgtaaaatgattgggttagctcctgctgcaaggttcttcataccagcgttgatcattgcctgtgctaaaacagtagctgttgtagtaccatcaccagcaacatcatttgtctttgttgcaacttcttttacaatctgagcacccatgttttcaaatggatcttctaattcgatatcttttgcgattgtaacaccatcgtttgtaattaatggagcaccaaagctcttatcaagaactacgttacgtccttttggtccaagtgttactcttacagtatctgctaactggtttacacctgcttctaatgcttttctggcttctacgccatatttaatctctttagccataataaagattcctcctgctatataaaaatatactaaccaaaaatattaattatgattacttgtttcaatccacacttgacaattcatagaatctgaatagtcaaatgtgactaatgattaatgtcttgtcagaaaagaatatcatctgtattctgctgacactagaattattctacgattgcaagaatatcactctgttttacgatgatgtactcttcttcttccatctttacattcgttcctgcatatttagaataaattactttctgtccaacgctcacttccatcttcacatcttctgttccaggacctacagcaactacttctgcttcctgtggtttttcctgtgcggagctagtaagaataataccagtctttgtctttgtttctgcctccagctgttttaatacaactctgtctgctaatggtactaacttcataatataatgcctcctaattcaaaattaattgtaaatctgttatcttcttgatttttatgttgttagcactcatttcgtttgagtgctaattgctaatacctataatatgttttttcttttataattgcaagttctaaaaatccttatttttttattaatcagcttatatagatatttattttaaattatctcttattttctaattatatctcttttttactcttgttttcctttgcctataatatttcttttccaaagactttagacgaaactttccatttccccaaatatcaataatctgtttatacccgcttttcgtctttataatatctcctatcctggcatctggcggaagtttaaacttccccggcactttccgcatcttatttctgcttttcttctttccatatattttgcgaggaatttcacgcatcctctccattactgtcattggctctgcttttctgctatttctttcttctgcattcaccatcacggagcataaaactacacctataagtattcccaatccaatcttccttatccacataaccttttcctcctgtatctccataaaaatatatgagtcttcgctttctctctataatatagacataaaatttatgccagaagttgcatttttacaaaaaaagaaaagcgtactattttatatagtacactttatcacttttctgattttattacaatgtctgtgcttttctgatttttacccgacaatttctatcatattactttttagcatgcgagcagactacataatctgtatcataggatagttgattcttctttactattccacattttttacatcgctgcgcctcatatgcttcaatatggcatcctttctttttcgatttatgaatctttagtgttccctcctccataacatggttacatctcttttgctgtgcctttttctggcctttatcagaaccattattcattaaattcgactggaaaactggtgtgatttctctctgctttgattcaaataaaatggtcgatttactaaagtcaagagacgcatctcccatcgaaacatcttctccataaaaataatcccattctccttctgtaaaagtattatcctgggctggcacatcctgttcctgcgttgcactataaacaaaaatcgtcataaaactacacagacacattactgttagaattcctgctataaaaagctgtatcttccctgctggctttttatcttcatctaaaattctatcaactcgttcctgcatcttttccccattattcgtaagtccctgcacaatcgccaacccccgtcttggtattgtcaaagttgctgactttacgaggaaaattgcgtaattctttttttcctctttattactattctgcatacatactgcatcacaatagtattcacacatcactgaatattgttgaaaaagataatacacaaatggattataccaacgaaaaatgcaaacaagaagtgcaagcgccttccagaaagtatccccatgccgaacatgtgtaatctcatgtctgagaagccactccttctctttaactgtataatctcttttcgggataaaaatattcgggtgaagccatcctactgtacaaggtgttttcacttttgccgtctgaaaaacttcaatatcttttcccctttttccagaaaagaagtctgtctttattccattcttccttatctgcctttttataaaaaaataggttccataataatatataactaatatagtacaaataatgaaccatataactgttaccaaaaaaattcctctcggtattacataataatccccaaataataatggaatatttacaacttcaaatctacttattttcttccctgcaatcccccaaaaatcagcaaaattaaatcgctctaataactttcctggaagaatcaaatatttaaattcctgaaacggacacaaatataaaataatagataatcgcaatatccatatatatttttgtgccgtcatgtgtttcttaaatatttttttaataagaagataccctaagatgggaaatgtccccgccatatccatcacaagttgtagtaccatcctttttcatcgcctctttccccagctgtctgttattacctgtctaaaatatgtgcgatcagttccttttcatcaactttcgtaattgcattatttccagttaatgctgcaataaaatgactaatcttgccttcataacattcttcaagaatcgctttcgccttacgctgcttaaactctgcctttgtcagtgcagccccataatatgcctttgtctcttctttttttctctctagcagccctttgtcaatcaaacgacttaaaaaagtattcaacgtctgttttttccagtttttatcttcttcctcgttaaaatacttcatcaattccccaaaagtatacttccccctgtactccagaaatactccataattctgtattctgttttacttaaatgactgttcatatacttcttcctcctgctgttctttgtgacattttcttaacatattaactatactatgtcaccagttatcacgcaagtggtttttgatttaattcatcaagaacaaacagacgaagccattgaagccaataagccatatttgtgattttaatcgcggcgcgttgaatgttcgctttcccgctcgcatccaacacttgctccgagaccacaaatatggcttattggcttcaatggcttctggctgtggcaggatttcgatgaattagaatcaatgtataggggatttgagggagaacgcggaagtcatctatatttaacatgtaataatcccatcctacagatattcaaagacagaagcggaaaaagatagtataataacaaatgtgactttagtcgcggcgtgttgaatgttttgcttactggctcgcatccaacacttgctccgaggtcacatttgctattatactatctttttccgcttcgtctgtccatccaaggaggtttttacatgaacaacaaaggccgttatcacaatgattatagtcctcgttatcaggatgcttttgatatttacgagaaagctaaaaatcatgcaaaggaacaacgaaaaaaagagagactacactctctttcgattgttgaacaggaacatcgcaacagaagcggcgatgataataccatatccaacaaaactccacatgtccggaatctgtctaagaaacaaaaatccaaggacggtggagaagataatctgtgagtaatcatagatggagatttctcctgccggtgcacaggtataggcagcagtaattgtgaactggcctccgcttgcaaataaacccgcaagaagcaggcagccaagctgtgcaagtgtcatcgggtgaaagtcaaatataagatatggtaatgtcacaatacaggaaaatgcggagaagaaaaggacgataaacggtccttttactccgtttgttccgagcttccgtacataagtataggcgattcctgctcccatcccacctaaaaggccaacaaaggcaggcaaggctgtcacagaagcaaagcccggcttaatgataaataaacttccaacaaaggcaataaatacacatcctgctgcaaacggatgtattttctcttttaaaagaataaaagaaaaaagaatcgcaaagaacggggacagcttatttaaaatggatgcatctgcaagcatcagatgatcaatcgcataataattacataaaataccaagtgttccacagacagaacgcatcagcaggtttttaagctggcctttcggtacgtgaactggtgtatttgaccttttcagcgcaatcagcgcaaaaaataccgcaacaaaattacggaaaaaacttttttcaattgatggcaaatccccggcaagccgaaccatcatgttcataagtgcgaagaaaaaagcagacataatgatcaggatgattcccttatttttctgactcataatatatttcctttctataaatttttaaatggcaaaacagacgaactctggaaactatctactctctatctgtgactttagtcgcggcgcgttgaatgttcgcttacaaacaactccagccaaagtcagctcctaaagagagaatagaacctatatttgtgacctcggagctgcgaggccacaaatataggttctattctctctttaggagcgtctcctttgatgtctgtttcttttactctgaagctgtcgtactctccgctgcggaatctgtagaagccgccggagctgtctctgtccctgcctgtgtagtaggatcagtgcggtaatgaactgttcctgcctcaagtgtctctcctcttgcttcataaagctctggtacagttactaactggaatccttccgcaatcaggtctggaacgaatcgttttaccgcatctacgttatactcatggatgtcgtgaagcaatacaacatctccgtcctgcgctttcataacttcattataagtggcatctgcattctttgtcttccagtcttctgtatcaagagaccagttcatacagcagaggttgtagccacctactgcggataatacagtcttatttaccgctccgtatggaggacgcattaaggatggcttaacaccaattgccttattgattgcatctactgacttgctaatctcgctatcaagtgcagatgcacttaagcttgtaagaacaacatgactgtatgtatgagttccaacttccataccaaggttatattctctctgtactgtttctggataataacctgcattctgtcctaaacagaagaaagttgccttcgcataattctcctctaatgcatcaagcattggggttgttgtttctgggttaggaccatcatcaaatgtaatagccaccatcggtttacttgggtctatagctggataaattcttaaatcaaaagatgcgcttaatttagaaccatctgttgcagttgcagttacctttacggtattcttacctgcattcttacctggttttaatacgccatcctttgttacagttaccattccatctttgctgcagctccatttaagctttgtatttgtagcattggatggttcatggctgatttttaattgcatggtctgaccaacacgaatagttgttgccggtgctgtaacttttaaacctgtcattggcacactgttatctggtgcttctgtagaagcttctgttgcctttgcggaattaccttccttattgcctgccttattatctgcagatgctggtgaagcaagattcttcataattgcaaaaatgccacataataatatgactacaacaacgactgctgcaatcatcttaccagcacccgactttttctttcttctcataattgcctcctgtaaaaaaggcgaaaatcaaggtatgatttccgcctgcttttaacttattgcatagtcccgaaacctcataaagatatttcgaaatgaacaaaaattatactctggataagtattctcctgttcttgtgtcaatctttaacttatcgccaagatttacgaataaaggtacatatacaactgctcctgtctcaactgtacaaggcttagttgctcctgttgctgtgttacctttctctcctggttcgcactctgttacttctaactctgcaaacataggtggttctacagcaaagatatctccgttatgagaaatcatcttaaccatgtcgttctcacgaacaaacttaagagaatcaccgatcatatcttcgtttaatgcaatctgatcgaatgtctctacatccatgaagtaatataaatcaccatctgtatataaatactgcatatctgtacgctcgatatgtgctggtgggaacttctctgttggacggaatgtcttctcaacaacaccaccgttcttaatattcttcattttcgttcttacgaaagctgcaccttttcctggttttacatgctggaaatctacaatctggtaaacatttccctcaagttcaatagttaagccatttttaaaatcgcctgcagaaatcatatctgaaaatcctccttaatcactagtaaatcattcattaatctattctataataaatacctctatttttcaacactttttttccttatgcttcggaaatagaaaaagaggacgactttttccagatatcgtttgagtacaatctgtatctcttcctttgggtgaatcggcttaaccatgatggcatgaagtccggctcttttggcacctaatacatctgtaaaaatctgatctcctataaacagagtattttcttttgttgttttcattctccggattccctcctcatatcctccaggcagaggctttcctgccttaaagacataagtagaacctactttatcacaaaagctttttactcttggttctttattatttgatatcaggcaggtctgaaaaccaatctctcttagctttttaaataaagcaaccgccctcttatctgccggtgccccatgaggtactaacgtattgtcaatatcaaataaaattccccggtatccgtctttatataactttttaaaatcaatggtataagtcgagtccagatactcatctggatataacatttgcagcataaatattccctttcttatcctttgcatccttaataatatacatatttctgaacagttatattcattctcataaaacaccagataaatccttatccttctcagcattttcatacctaacctgataagctacatgtattgctcataactgctcctgagcttctccaatgcttttttctcaattcggcttacataggatctcgaaattcccatcattgccgctacttccttttgcgtgtgtggttcatttccacataaaccataacgctttaaaataatttcccgctctcggtcatcggtaagaaggaacacttcctgttctaaacggcttagatagtatttgtgaagatattgttctatgagttctgcttcttctgttgaaatgatgtccagaagactgatatgattcccctcctggtccgtaccaatcggttcatacagcgaaacttcccgcaaaatctttttctcctggcgaatcatcatcaataattcattctctatacatctggccgcgtaagtaacaagccgcccccctttatttaaatcaaaagtatttactgccttaattaatcctatcgtgccaatcgaaatcaagtcatccaggtcccggtctggtgagttatatttttttacaatatgggcaaccagcctgagattatgctcaattaatttttctttcgccttctcatctccgtcacggtacattttaagataatatctttcttcttccgcctttaatggcttcttaaatgaccgcatacaacgctccgaaacccgtgttccttatagtatatgcatgacaggatggccactgttcctactcttttctacgaagcagaaatcctctttccaaagcttctccaaagttaatccaaatctcctgctttggatgtggtgcagattctactgaattacggtcgccgtcttccatcgcaagtactggaagatttttattgcttccatctggcagcattacttcaataatctcgcctacagagaacttattacgctgataaatcttacaccagccattctcatcaatatcctgtacaataccgatgtaagtatattctttgatataggtgttcgcatcataaatctgagaattctcatcggtctttccgtagtagaaaccagttgtaaactgacgataggtgcattttgcaatttcttctcgataatagtctaaattcttctcaaataaatctggtgatgttttgtagtcatcaatcgctcttctataagttcttgtcactgctgctacataaagagctgtcttcatacggccctcaatcttaagactgtccactcctgcctcaagcaaatctggaatgtgctcaatcatacacaaatctttggaattgaaaatgtatgtgccgcgctcattttcctctactggaagatattcgcccggacggctttcctccatgacatagtatttccagcggcaaggatgtgtacaagctcccatgtttgcatttcttccagtaaaataattactgagaaggcatcttccggaatgggaaatacacattgcaccgtgaacaaaagcttcgatttccatatcttctggaatgttggcacgaatctcagaaagttctgctaaagaaagctcacgagctgccacaactcggcttgctccctgtgcgtaccagaaattataagttgcgtagtttgtactgtttgcctgtgtactgatatgacgctcaatgtctggacattcttccctagcaatcataaatacgccagggtcagaaataatcagggcatctgggccaatttcttttaattccctgaagtactctctgattccctctaaatcttcattatgcgccacaatattagctgtaacgtatacttttactccattttcatgagcaaactttacgcctgcctccatatcttctctggaaaaattgcgggcctttgcacgaagtccgtacatttccccaccgatatatacggcatctgcaccgtaaagtactgctgtttttaatacttctaagctactcgccggtatgagtaattctgtatttctcatcttatccctttctttcttctcattcttttttcacactgattgccatgccatctcctgtttctaaaatcacggtatcaagcgcttcatcatgtgtcaatgcatataaatactctctcatgcgattatgaatcgtatgatttcttctcttaatcccataacgggattcaaaaatatctccatcctgcaaaacattgtccgagactaaaattcctcccggggccagaagccgcattacttccggcataaagtgaatatactgtcccttcgccgcatccataaaaataaaatcccagcttccggaaagttctttcaacacttctgccgcatctcccgaaattaacgtaatcttatcttccattccggcaagtgcgatatttacttttgcccgctcaatacgcggcggataattttcaattgtcgtaatgtgtgtattgttatctgtattttcacccataaaaaccgaagaaaatcctatggcagcacctacctccagaattttctccggttttttaatttgcagcaatattcgaagaagttcccctgactctttgcggataatcggcacatcatctctgatggcttctttttctatcatatgcaaagcctcagaacctctgtctactccaaaggaacgaatgaaatccagaactctttcttctgtaatcactgtattttttcctcctcatgtgttagctgttttaatatttctgatggcttctcagaagaggaaacctgatattcccctggccggatattctgatatccatccatgcagcgaagagatatggcaaacagatacggattctttacaatcccctgttctgccaaatctttagaaatctcaagaagagattccccctgctctacgacaagtacagtctcgctggctatctgcgggttcttatcctttggcttatctgcaaaaatagcacggccaactccgctcatccgcacaaagagcaggataaaaagaagtactataaagatatacattaatattttgataattacatgtaatactttctctgccatgtttttcactccttttatcctagagcgtgttttaaaacacgctctaatataacttatgctctttatccaaatccaagctgtcaatttatctttattttaatccatagttaatcattcgtaaaaccaaaatgaatgttcatctcacgtctgacattttttgttctgcaaatagtctgtaatttacgaaatctgaataatccgatatgacttgtaatcatagttcatccatataagataaatccagcttaatattctctgcaataccatcatataccagccgcatcagtttacacatccgctgctctgcggaaagaaagtctaccacaactggttctgtcagcacatctttatactctgaatgaagtgattctattttttcaaagtattgttcctgtcctttttcaagctgtaaatacaaactttttccacgaaattctttaaacttacgatataattcttcctgttctttcaaaacagtcaggtctttctgataacatttgtaatcttctgtatgacaaatcatatctgtcaacttctttgtaccctgacgaatatcttctgtatcaggaaagaacggtattgataactttccttcatccatcattgtctatacttccataataatcggaagaatcatcggacttctcttcatcttcttccagatataatctcctaaatcatcacggattgcccccttaatacgtccccaatccgtaatcttcttcgagttacaatgctctaatgtgttcgtgacaacactctttgcctcttccatgagcttctcgctctctcttacataaacgaaacctcttgacacaatgtctggccctgccagaagaaccccattataacggtcaagtgtaacaacgacaataaataagccgttctgtgataaatgctggcggtcacgaagtacaatattaccaacatcaccaacaccaagaccatctactaaaataccctgtgcaggtacatgcccggtaacttttgcctgctcttttgaaatggtaagcacatcgccagactgtaagatcattacattttcttttggaatacccatctcaatggcaagatctttatgtctctttaagtgacggtactctccatgaactggaatcgcatactgtggctttgtcaatgtgtagataagcttaatctcttcctgacacgcatgtccggaaacgtgagtatcctggaaaataacgctggctcccttcttggcaagctcattcattacttttgatacagccttctcattaccaggaattggatgagaactgaagataattacatcacctggcttaatagaaaccttgcggtgagtggaagctgccatacggcttaatgctgccatcgtttctccctggcttcctgttgttataagcacgagctgctcatccacataattcttcatctgttctatatcgatcaatgtgttatctggaatcttaatatagccaagctctgctgcagtagagattgtgctgaccatacttcttccctcgataacaaccttctttccacaactatacgcacagtcaataatctgctgtacacgatctacgttcgaagcaaatgtcgctacaataattctgtggtctttattctcatcaaaaaggtgtcggagagttcgtccaacggtcctctcggatggcgtatatccctcacgctctacattggtactctcacacattaaggcaagaacacctttctttccaagttctgcaaaacgaccaagatcaatggcatctccaaataccggtgtgtaatcgatcttaaagtcaccagtatgcacaataatccctgctggtgtataaatagcgagtgctgccgcatcactgatactgtggttcgttttaataaattctatacgaaatcttcccagattaatagactggccatgtttgatgacctttcttctggttgttcttaaaagattatgctcttttaacttattctcaataagtcccattgtaagctttgttgcataaataggcatattcagttctttaagagcatagggaatcgcaccaatatgatcctcgtgtccgtgggtaattacaagtccctttacctttgaggcattctctttcaaataagtgatatccggtataactaaatcgattcccaacatctcatcgtccggaaaagccagaccacagtctactacaataatactgtcctcatactcaaacgcagtaatattcataccgatctgctctaatccgccgagaggtattatctttactgattgatttcctgttactttcaaattctaacctccgttctactattcacttgtctatatagcagaaagcacaatcgcatagaataaaacggacatctattcctgccaaatatctgccgttttatctcacacgaaagcctgcctgctattctacttcaaaattaatatcgtccattaactgctcaaatactttggatactgatataagttcttcctcgtcttcaaccatctcataggttgcccattcttcatcctcagccgcatcagcaactcttttcatgataagaacttcaacctcctcgtcatctgcatctgcacttccgtcttctactaacagatagtgaaatccattcagagttgtctgttcgaggacatagaactccttttcttttccatcttcgtctttaaatggaatactctgataattgttcatataaaacctctttcttccgtacttacgtccgttctccgcttacttttccggaattggatgtacatccatgtaactttgcagaatcagagtagccgccatccagtcaatgcgttctttcctgttctcacggcgcactccgccttcctgcaaaattctctctgattccatcgtagtcagtctttcatcccataagactacttccaatccggttctgcgctgaagcatcgcctgaaactccttcgtctcctcagctctttctcccagcgtattattcatattctttggcaatccgagtactatcttactcacttcatattcttctatgagcgcttctatccttgccaatgtctggcgcagcttcttattcgactttctggtaactgtctcaactccctgtgccgtaatacccaaagcatcacttaccgccacacctactgtctttgtcccgtaatcaagacccatccatctttctttcataattactttaactgagtatcaatataattttcaaataaaacttcaagaatctcgtcacgttctaccttcataattaagcttctcgcattcttatgactggtaatataagtcggatctccggacataatataacccacgatctgattcactggattatatcctttttccgttaatgcttcgtatacatctttcaaaatagatgctacatcatattcctgttctttaaccacatgaaaaaactgtgtattatttctacccatgtctacctccttctagcagatttacaatcaataaatattttactatgagtgacattaaaattcaatcgaaacttttccgtacagtaaattttcatcaataaatccctgaatatctactacaattacctcattttgttctaattttgtatcattttccgttaattccactgcaactttcacataatgagccgtatatccctgaaaatattttttaccatttttctctacaatttcttctaaaagtactttttcttttcttccaacataccattcttcaaatgctgtcttgtgcctttttgccatcgaaagaagcacctcggaacgttctgtctttacctgttccggcacatgcccggacatcttctgtgctcttgttccttctcgtacagaatacttaaaaatatgcatctcatatagattgattttctcaagatatgctcttgttttttcaaattcttcctcagtttctccgacaaaacctgcaataacatcagttgttaatgccggatgctcatagtactttcttaaaatatttaatgcttcctcatattcttctgttgtatatttgcggttcatacgctttaatgtctcgtcgcagccgctctgtaaagaaagatgaaaatgtggacatactttatcacatttcacaagttcttttacaaactcctctgtgataattctaggctctaaagaacccagacggattctctccacatcctctacctgctgtattctcttaatcacatcaagaagagtcactgttcctaaatctttcccataggaacttaaatgaattccggtaagcacgatttctttataaccctgtgctgccagattttttacttcttcaatgacttcctctggatttttactgcggattcttcctcttgtgtaaggaatgatacaatacgaacagaactgattacaaccatcctgtattttaatatatgctcttgtatgctcgtttaccttatgaattgttaaatcttcatattcttttgtgtgattaatatcaattacttctgagacaactggtacctcctgctctggttcttttgccgcaaaatattcctcaaggatctgggcgatatctttctttttattattaccgacaagaatatccgcctcatttttctttgctagttcttcctctgctgcctgcacataacaccccgctgccacgataattgcatccggattgtttttctttgcacgatgaatcatctgacggctctttctgtctgccatatttgttacagaacaggtatttataatatagacatccgctgtctctttaaaactgacaatctcgtatcctgccttttcaagaatctcctccatggcatcagtctcatactgatttactttacagcccagtgtaaggaacgccgctcttcttttactcataaaaacaaatctcctttttccgtttctccttttcgttttttctgttatttattatttcctacctgcaatcctattttttctaacttcattcatctccagattcatgccaaaaaattcccctttatctttagataatattttccaaatcttcctcaaatctattgactttttttcactaaaaaggtactatattattaaaatatatatagacatttttaggaggagcgcgtatatgaaaacgattaaaatctctttaaattccatcgataaggtaaaaacatttgttaatgtcatcaatcgtttcgatgcagaattcgatttagtttccggtcgttacgttattgatgcaaagtctatcatgggaattttcagtttagatatttctaaacctatcgatttaaatatccataacgctgataatcttgatgagattatggaacagttacagccatacttagtaactgaataattacataagagcgggttttctggtatacggatatattatatataacctgtgatgtatttatgaaatcaaccgaggaaatattactttcctcggttctttctttacagataaatttttcttatatgaatcttcagataaaacaaatatttttagtgatatttcttcttcccaccttttaaaaaggcacttatctgcaagcattataaacattatcaaaatacttatgtctgccttgaaaatgctttcatccattaatactttagtgagcgttaatcttaatttcttctgttgtttcaatcgctgtcttcatcagctcgtcaatacaatcatcaagatttctctcagaacgcttaattacatctaatcttggctttgttaccggatgttttgccacaaaaatagtacagcagtcttcgtatggtaaaatagatgtctcatatgttccaatcttttctgcaacttttacgatttcatttttatcaagtccgatacaaggacggaatactggcatctggcacacttcatttgttacataaagactgtgcattgtctgactggcaacctgtccgatactctcacctgtaacgagggaaagacaattatcctgatttgcgaaatgctctgcaatcttcatcatgtaacgacgcataatgattgtcaattcatcatgaggacatttctcataaattgccatctgaatatctgtaaagtttacaacatgtaatgtaataggtcctgtatattttgcaatctcttttgcaagatctactactttctgtttcgctctctcacttgtataaggaggtgcatggaagtaagttgcgtcaatgcttacacctcgcttggaaatcatgtaaccagctaccgggctgtcgataccaccggaaagaagaagcattgctcttccgtttgttccaacaggcattccacctggtcccggaatctctctggaataaatgtaaaccttatcacgaatctcgactgtaagcataacatctggattatgcacgtcaacacttaagtcctcaaacttctctaataatctctctccaagacgggcagctgcttccatagacggaattggatacttcttgtctgctcttcttacatgtactttgaaagaaaaatgcttatctgcataatcttcatctacatatttttctacgacttccgcaatcttttcaaaatctttatcttcttctactacaattggacaaatacctgcaataccgaatacatggcttaagctttccaccgcctcatcaaaatcatactcttcattggcatgtacaaaaatacgtccagattcctttctgatagaaaagtctcctactggttttaatgcatatttcatctgacggacaagggcatcttcaaagaaacggcgattatttcccttgattccaatttctgcatatttaatcaaaaatgctttgaattccataaatatctccttttttatatgatgtactctcgtagtctttcttgtcacaaaatcaagctcaaaaagattccgagagtacattatgttctaattgttttatcgtcttgtaaatctccgaagcatcggcaacagttcttttaacgcttccacacaaatatctgcttcttctaccgtattaaaaatagagaatgaaaaacgaagcgtcgattcatagtattcctttgtaagaccaatgcccttcaaagtaccgctgacttccggtttattagatgaacaggcagaacctgctgatacataaatctcacgttcttctaatgcgtgaagaagcacttcacttcttactcctaaaaagctgatactcgccacatgcggagcatctccggaattatctttcacatctggaatctcttccatcactctttttataaaatgatcttttatctctctgatatgtgcgatcttttcctcatgattctcataaatcaactctgccgccttaccaagccctgcaattcccggtacattttctgttccggaacgcattcccttctgttgatttccaccccagatgattggctttatctttgttccattcttaatataaataaatccgattccctttgggccgtgaatcttatgtccacttacagaaatcatatctgctttccatttcttagggtaacaattcaacttaccatatgcctgaatacaatcggtatgaaataaaatctttggatcaaaagactttacaatctttccaatctcctcaaccggttcgatggcaccaatctcattattcacgcacataatagaaaccatcaatgtatctttacgaagcgccttctttaatgcctctaaatctacgattccatgttcatcgacaggaagataggtcacttcaaatccctcatcttccaaaaaagataatggattatatacagaagcatgttcaatacagcttgtaataatgtgctttctctctcttttatttgcaaatgcagtaccgatcaatgcaagattattcgcctctgtaccaccagaagtaaaataaatctcctttgaatcaactttcaggctctttgcaataatctctttcgcatgattgacatacttctctgcatcaaatcctttcatatgcatagaagatggattgccgtactccttctcaagtacttcatccataatctcacgcacctgcggcagcgctcttgtggtcgcgccattgtcaaaataaatctctgacattctcgtttacaactccttcaaaaaatatattatgtcttattgtttttttgttccattctctacactcaaaaaacagccataaaaaatggcataatcgtatataaacataacataaaatgagagagaagtaaaatggattttgcggataaacagacgaaaatgaaaaaggatactcccctcaagctgtaaagatagtcgttcgagcaaaatgctcagtcgcattttcactcactccgacattacatcttgaggggagtatcctttttcattttctgtttgttggctctccaaagtcattttactggctgttagagaagaagtggttaaaaaataataactttaagctttatgattattttatcttatatgactactttaccttgactttaaaggttgcttttttgttacttccgtcggttgccatcgctgtgatttttatagtttttcctttggcaacctttttagttttgactacgcctttggcattgactgtagcatatttcgcgttggaggatgtccactgtaactttttattcgcttttttcgtagcggttacgttcgcttttaatttcaggctttttcctgctttaacagttttagttcctgtaatttttaccttctttacgattcctttcatggaagttactttccaggatgcggaaacctttatcttatcgtttgatgctgttattgtaactttctttcctccggttttctttttcactgttacaacaccatctgcgttgacagttgctaccttggtattgcttgacttccaggttaactgttttgttatgctgtctggcagcccgatttcagcctttaagttcacctttttgcctgcggcaatctgttttggctttccggttgctttaaaaggttttatagatggagcatttgttgtgttaccagatggttttgttgtgttgctggacggtttctgggttccctgatttgcattttttgaaaaatgtgctgacaggtttctgttattctgaacacagaagcggtattctttttcttttgaaatcagattatcattttcataccatcctgcaaatgtataattagtttctggctctgcagttacctttgcatattcgctgatcgtatagcttccgccacctgtaacacttccacctgactgcgcagtaacatttacctgttttttaatatcttcggaagcacctttttctatcgaaggctgtacttcatctccactgacatttttaagcgtttctgtagaactttctgtatctgtttcaaatgtacttttgtaaacttctccttcttttatcggaatatcaacataactttttacctggctacattcattagtttccagattctgattcataacggtatatgtcattgttccgttatccgttgcttttaaatcctctttgtagtcagcatcttcagggatacatacgattttctgaccattttcatcaataggtattaaatgtgttagcaaatatgcattatcaagaggatgctttgcagcaagtcctggtatcactcttgcaattgtcactgcaagggctccggtatccaatccactgttctttcctaatactcctgccattccactaatcatatttgcctgcagcctcatataataattttctctattcactgcaacatcgcataaatcatccatcagcttatccatcatagaagcctgcgcaagcccttctttcgttaaatataccaccgcctgcattggaagatataagtttttcacttctttctccgtccaatcatacattctcgctcctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctaggatgcagacagatattatgttatccaaaaacaataacatacttattattgatgccaaatattattcgcatatgacccagcaacaatacggaatacatactctgcattccaataatctttatcagatttttacctatgtaaaaaataaggaatttgaattgagaaactatgaacatactgtatcaggaatgcttctttatgcacaaaccgatgaagatattattcctaataacacctaccatatgagcggaaatcagatttctgttcttgcattagatttaaaccaggatttttcaaaaatctccagaactttagatgacatcgccaaaaattttctttaaaattttt

SEQ ID NO: 13 - DNA, 31538 bp, Eubacterium hallii WBS-01
accagttattctgtggaagaagacagacagcaattctaaataatcgcagaaatccataccattgctttcactgcagcaggtatattaaaatccgggaaagtatccttccaaacatacattaaaataatataaaatacagtcattgtgattgaggatatctgtaatccaatcccaagctgtttctttattctatcattcgttccacgtgcagctcttatgattctaggtactaaatgaaatgcatctccaccgcaaagagtcaatgttaatattccataaagaataaataatgtatttccttttgcataggtgaaaaataaaattgctgctactaaatcaaatatcaaatatccggcatcaaatatcgcttccataatatccggcatctttggctggtatttttcttctctcattcttacttctcctttttcattaattggttataacaaaaatgatttttcattctctccctccgcatatttttttaagtatgcatctgcattagcacaaattttattaaataccgccatgcacatatacttttcttcttcggttaatccatctaaaacatttttagcgaattctttctgtgctttcattccatcttcgataatagactctgccttatttaatataacaatctcaatatgctttttattccgggcgctctgaattctttcaatcaggcctttattctctaatgctttcagagaagtagatacatgagatttcgttgatttacgaatctttacgatgtctgctgccgtattatgcttcggattattatgtaaaaacataagtatatcatattccatttgcgttagctgatacctgtcacatacttttctcgtaaatagttcataacagctagtgattgttttatgctgatccaaaaaaacatatttttactccttgttatatctccttattaatgttctatttagaacgattatgattatatagttctgcttcctttttgtcaagccttgatttttatatgtcagcttatactgaccagaatcacgcgccaagtctcgcagcggctcgacttgaattttctctcttaaatctgtggacaaaaaaagataagcattattctgcttaccttttttctcaatctattctttattaacaattaatggcagctgtggcttccacatccatgctcgccacaggtatgtccctctccatgatcatgatcatgatgactgcactttacatcaggattataatctaacgttccgttcataaaagcttccacagccgcatctgcatcaccggaaacgcctccatagagcttaatccctgccgctgataaagccatctgcgctcctcctccgattccaccacaaataagaacatctgccttcaatgcatttaaaacacctgctaatgcgccatgcccgcttccattcgtatcgacaacttcagaatggattacttttccatcctgtacatcataaactttaaattctgctgtatgtccaaaatgctgaaaaatctgtccgttctcatatgttactgctactctcattataccttctcctttttctgttgcatacttttgataaaattcttgtttgtagcatccacccagaccacatttactattttaccatcgcagattcgaaaatctccccttcaattcgaagaggatgtccatctatgattgcatctgccactttctttctggcaatctcatagattctttgaacagtcgttcttgcaatctgcataaagcctgcacactgttcctggctgtatccttctttatctataagacgaatcgtttcatattcatctactgtcagaagaatcacctctttttcatcttcctcccctcttcttccatttttattggatggtcgaaattccaatatatctggaaaatggcagacttttctgcactttatcggtcttggcataggatactcctttcacaatcttttctttatactacaatatttatgaacatatgtcaataacgtagttgacatatgctcatttcacttattttatagaatgggaagcattgtcctgtaaattgtttttaaaacagtcatttaaataaatgatatgcgataccgctacaattacactatgaagcatctttttttcgaacggaatatcgcccatatctttcattggctcttctttattttcaaatatagctacgagtgtcttttccaattctgaacagaaataatcataagcaaccggtaaagtataggttgctttttgtaaaacaaaaagggatgctatattatccatggaaagaacctgctttataattacaatataaatagtatatgctatttgatccgcataatactgtttttttataggacggtcaatataccccttctttacataattacttaacatagatggtgtaatcgaaatctctattggtgctaaacattcattgatatactttactgtctgctcaagataaagtcctacatttggaatttctttatatcttggcattctgtagtctctggctgaaaatctcataatacattccttctttcttactttgtctctaacttgatgccacgaattactccgcagctagagcgtgtttgaaaaatgctctaacgctgctcccataattctgaacatcattatatatcagctattaaaaaaccgcaataaagttatttaataccttgacaaacacatatgtatggtttactatactttttgataagttttttaaaaaccgatataaaagtatttaaaactattcacggaggttacatatgaaaatgaaaatcgttgcagattcatctgcaaatcttttagctttacctgatatagacttcggggttgttccacttcatataatcgtaggtgagaacgattatatagatgatgataagattgatcttacagctatgcaggagaatctttcttcttataaaggaaagacatcgacatcaagcccaagtcctcacgaatgggagaatgcgtttggcgatgccgatgttgtcttttgcatcaccattacaagttccctgtccggtacatataacagtgctgttatcgctaaggacatctatgaacagaatcataccggcagaaaggtatatgttttagattctttatctacaggaccggaaatcgcactttttattgaaaaaatagcagaactcataaaagctggttttgctccagatgatatttataaaactcttctcgaatataaagataaaacacacctgtatttttctctggcatctttaaacaattttgcaaagaacggacggataagtccggtaattgcagccggaatcggtttattaggagtcagagtcgttgggaaggcaagtgatgaaggaactttattgccgcttgacaaatgcagaggtgaaaaaagagcattaaaaaaactaattgatcatcttaaagaatgtggttatacagatggaaaaatcatcattgctcataacaacaatgaagccggtgcattagaattaaaaaaattgattgaaaatacatttggaatttttaatggaacgattcaaaaaacaagagccctttgcagttattacgcagagccaggatcccttctcatcggttttgaagcatccctttgtaaccataaaccatataaagattgatttttaaaagtctactacccctatacgctacatgtgtggctatggcagaacacatcagtggtagtgaagatgcttttgtcgccaaaatgaacgagaaagcacaggttcttggcatgaagcatacacattttgtaaattgctgcggattagatgcggacggacattacacaagtgcaagggatatcgccttaatgtcaagagaactgattacgaatcatccagacattttccattatacaacaatctggatggaaaatattacacatgtaacaaaacgagggaaatctgagtttggactttctaatactaataaattactccggcattatcagggcgcaaccggtctaaaaaccggaagtacctccaaagccggcttttgtttaagcgccaccgcagaacgcaatcacatttcccttatcgctgtcgttatggcatgccaaagctcaaaagagcgggtaaaagactgtgcctctttacttgattacggcttctctctctgcaagatttacaccgataaacagcctcccgcactctccaccgtccccgtacataatggcacaaaagaattcatttcctgcaaatataagaaaaacttctcctatgtttttacttcggaaatcaaccaaaataacattcagaaaaaagtggtattccagaaaaatctctctgctccaattaagaaaaatcaagtaattggcagactggagtattcatataataacaaaaaaattgggaaagtttctatattggcttcggaaacagtgggaaaggcaaaatatacagattatctgcaaaaactactactgaacttgtaaaataataatttcagttcagcaaaaaacagctcccaaagaaagaagatatcctatattgtggtcttagagcgtgtctaaaaaatgctttctgcaagatgtgcgttacaatttgtgggagatttcgcctgaatgagggcggcgtagcgggctacgtcaactgaatgaaggcaaaatataccgcaaattggggcgtgcagattgcaggaatgatttttcaaacacgctctagagtgaggattgaatgtgagccattcagcaaacattcaacccacagtgacagagtcacaaatataggatagcttctttctttgggagcgtctcctcttatcttcacaaattactatttacaaaatatcaatatgttctccagccaatgccttattcatgcttcttaccgcacagaactttccacacatagagcaagtatcctcatgttctggttttctgtcatcgcggattgctttggctgtttccggatccattgcacattcccactgtgcttcccaatctaaaacacggcgggcatctgccatcttatcatctatctctcttgcaccacggacaccttttgcgatatcggctgcatgtgccgcaatttttgatgccatgattccctgttttacgtcttcaagatttggaagtgcaaggtgttctgctggtgtaacatagcagaggaatgcagcaccattttgagcagcgattgctccaccgatagcggatacaatatggtcataacctggtgcaatatctgttacgattggtccaagtacatagaatggtgctccagaacaaatggtggactgtaacttcatgtttgcagcaatctgatccattggcatatgtcccggtccttctaccataacctgtacatttttctcccacgcacgtttggtaagttctccaagacgaactaattcttcaatttgacatacatcggaaccatcggcaagacagcctggacggcaggcatctccgagggagattgttacatcgtattcctgacagatatcaagaatttcatcgaaatattcatagaaagggttttcttctcctgtcattgtcatccatgcaaatacaagggaacctccacgggatacgatgttcatttttcttttatgctttttaatctggtcgattgtctttcttgtaattccacagtgtaatgttacgaagtctacaccattttctgcgtgaagacgtactacatcaataaagtcttttgcggtaagagtatctaagtctctctgatagtgaattacagaatcatagattggtactgttccaatcattacaggacattcggaagtcagttttttacggaacggttctgtatttccgtgggaagataaatccatgatggcatctgctcccatgtttactgcttccattacttttttcatttctatatcataatctttacagtcttttgatacaccaagatttacattaatctttgtttttaacatagagccgacaccctgtgggtctaagcatttatgatttttgttcgcgcagatagcaacttttccttctgctactaatgctctgatttcttctggtgtcattcgttcttttgctgcaaccttttccatttctggagtaataatattttttcttgctgcatccatctgtgttgtgtaatttctcatcttttgttacctccaattttgtaaatactatttataatgccatttttataaagcttaactaatctgtttatttcattactttatatacattgacacttgtctgttactatgtttacaaatcccacatatgatttagcgggccatttccctgtccaagattcagcattgctctaattgctccgctgatgtatcttttgccttttttacggattcttctacaggaaatccctttgccagatttgccgctaccgcacttgaaagtgtacagccggttccgtgtgtgtttggattatcaattctttcttctggaaaccaaacggctttttcttttttttcttcctgcaaaaaactctcataaagcaaatcgtccgcattttcttcgctgtgaccgcccttacttaagaccgcacaattccacctgtctgcaatgacttttgctgcttcttcccttgtttttttatcggtaatttttatcccggataaaaattcggtttctggaatgttcggggttagcagggaaacttttggatataatttctcatataatatctttctcgttgtttcttctactaaaaccgtaccgcttgtcgaaatcatcaccgggtctgccactacatttttgatagaatatttttccaggtattctgcgataatctctgcctgttcctttgaagcaatcattccaattttcaccgcatctggctttatatctgtgaaaatgctttccatctgttttttaaaaaattctgctggtactggcataatcccggtaattccgactgtattttgtgcggtaagtgcggtgatacaagtcatggcatatactttatgaacagttaaagtcttgatatccgcttgaatacctgctcctccgctcgaatcactgcctgcaattgtaagaactgttttcatatttgaaaaagaataatcacctatctccgaaaaatctctcacataaatattagaaagtttctggatttctttcgcatttcccacactgtaggtatcgtagatactgcatactggaaatccagcttcagtagcagttttcaccgcatataaagaatcttcaaatacccatgtttcctcttttttagtgcctagcttttgccttgcaagctcaaataccttcgggcttgtctttccggctccggcttcctcgcaggtaatcattcccgtaaagtcctgccatatgccgttacgaataagcgccgcctttgccatctccttatctgtcgctgtggctataattaacttcacaccattttctttcagacgttttactaaggcataggctcccggcttcatgaccgcttctttatagtaaaaatcttttacaacctgattgactccttctaaaatgtcttctgctgataccgaaaggccatactctttttgcatatagatggctccttctggcaaagataaagcatccagccgttcttttaaatctggctttgccttaatgccaagagtagcaagatatctcgctcctgcattttcccagatgggcatggaatcaagtaaagttccatcaatatcaaagattgctccttttatcacgatgcctttctccttttattgtcttttccactaactaccgaaaaattatttcagcattttttctgttctgtcttttaaaacttttgtagcagcttcaatatcttttgccgcaaaaatagcactaaccacagcgataccgcaaataccacttccctgtaaagataaaatgttatctgccccgattccaccaattgcaatcactggaatatttactgcctcgcagattgcttttaatgtttccttgctgacatctgccgcatcttttttcgtggaagtggaaaatacggctcccacgccaagataatccgcccccattttttcagctaatactgcctgctctactgtctgggcagatacgccaagaatcttgtcttcaccaagaatctttctcacgtcatcggcttccatatcactttgtccaacgtgaactcatccgcatccatatcttttgcgattctgacattatcattgataacaaatggaacatgatattatggcacaattctttgagagccaccgcttcttccatgaaatgttcctcatgagttccttttcccgaagctgtataaaagtcgctcctccttttaatgccttttccacctgctcgtaaagtgtttcatttccaagccaggaacggtcggttactgcatataaaagtaaatcttttcttaattgttctctgttaacgcagctcatactttgctctttcctccaatgtatttccatccatatggtaaatagcatcaattatccgattacggtaagtggaatttccctcccttcttttaaatgttcaaatccaatctctccggcaattcccatcgcacaaactgccgccgctgctgcctccaaaggctgcctgcgtttgcacaaaggaaagcgtcatcattccagaaagctggcatccagttccggtgattgctcccactctggttttccgttgcggataacataacatttttcagaatcagcaactaaatcaatggctcccgttacagcaatcacacttcctgtcgcttcagaaaatgctttcagcttcccaatcgtctcatcaagattctcctctgtaaccgcatctgccaaatctgcatccacaccttttgtatttcccgttccttccatcagggttcggatttctgaaatatttccacggataacagtaaactttatgtcccgcacagctcattcactgtctttgtccgaagtccactcgctccggctcctaccggatcaagcagcacaacatgaccaagtacatttgccttttttcctgctaaaaacatggacggaatcgtatttttattcagcgtaccaatgttaatattcaatccctgacaaatagaagtaatatcttccacttctccagaatcgtccgccatgatcggacttccaccacaggtaagaagaatatttgccacatcatttactgttacatagtttgtaatattatgtaccagtggatgcttttctcttacattatcaaaacacttctttaacatttttagctccttctttttttatatatattttcaagacatgttttaaaaatctttctgccaaatataccgcaagctaaaatatcggactgtagaaatgagatttttcaaacattctctgtgataactatccaaaataaatctgcttttctttacaaacttgactcgctgtacaaataaaattcatagttctttaaatagctatacatttcataaacggaaaattaattaagaatatattccatacagatatggataataaacgataaaaaagaaaaatatatgtattccatgccattttctttaaatgactagctttatatccttcttaaactttgaaaatagaatttcttttaaactctaaaaagaaaaacgcatatacaccaatctcggtatatatgcgaatgtatctacgctatccctacgttggcattatccaaatcaggttatgggtctaagcactttagcttactctcagcctgcttctgcaagctccccgtgtataaatttaccaatatagtacgctatttagggcaaaaaatcaagcataatttactattttattcactgggcagagctgacgttcccaaaacaacatcaagtgttaacattactgtaaatccaagggaaaaaaatatagttccaatattgctgtgttttccgacagacatttccgggataagttcttctacgacaacgtagatcattgctccaaggggcgttcctaaaaaggaaggataaattctctcacaaactatgacatatatcttacaagaaatatttttcaaacatactctagaccgtatatctgatagtaattactgcgtgcattttaacacaaggagtcaggcaagtgcaacatctaaaatcatcatcaaagtaaaccctactgaaaacatgaaaaatccgacattgacagactttccaacagacattttcggaactagttcttctactacaacatagaacattgcccctgctgcaaagcttaaaaagtatggcagaagcggaacaattaggcttgcggcccagacggtaagaatagccgccactggttctactgccccggaaagtacaccataaatgaaggctctcttttgggatattccttctgcacgaagcggcagggaaataatcgctccttctggaaagttttgaataacgattcctaatgcaagagaaaatgctcccattaccgtaatatgctctgctccacttaacagtcctgcataaataacaccaactgccattccttctggaatattgtggatagtcactgccaacagtagcttatttttacattttccatcaatacattctgacggtgcgaaatggtcgattgccatcaaaaataaaattccaatccagaatccacttgctgcaggaaggaacttccacacaccaatcgaatccacttgttcaagtgctggaagaagaagactccagatagaagctgccaccatcacccctgctgcaaatcccattaacgctttctgcattcctttgcttagttcattttttaagaaaaatacacaaaaagcacctaatgtcgtccccaaaagggaacactgatgccctttattatctctataatcataaaatccctccgagaccatatttgttctattctgcagatacctcttccgccgctttattctcatctgtttttctttctgtattctcttcttcccttttatattcctccgttttttcttctgtttcctcttttgcctcatcattttttgacgcatccttctctttttgtgtagtagcttccagattctttttatcttcttttattgtctcttctgttttttgtgtagctttcgttgatgcttcttctttcttatctgtactttcttcctgtcctttttcatccgagttttcttcctgtctttggcttctattttttacatcctttgtctgcaccttctcggtagattccatatctgcctgtacgaaaagctgctcactttttgccattgacaacaacaacattagtgcaaggatacacaataaaatcctttttgactttttccacattttgcactctccttactttcttttctccaaaaacagccatctttttcgaccatcttcgcaacctgactagttcccataatactaattattcaaatatgcaaaatttatgattataagaaaaggcaaaaaaatcaaaaaaagacagcctttgacttttactttcaaagactgtcttttttctacaaaatctatctaattattctgtttttaaacatgctctagtttgttgttgcgcgaagctgtgcttttaatccaacacggtttgtcttataatggaagaatggtctttctggaagctgaataatctgtgctgggtactcaaaatcctcaagggcatctgccacatcttcacgaatatcatcaattgtatagccatcctctaatacaacatataaatatggaaggaaatatcctttattctcaaaatcttcatctacaacaaagaatgcatcaatgattccatcaatttcggcatcgataatcttgttctccatattaagatcaatcagtcgacctccaccaactctgcggacatctcctctggtaagtgcaaacacaataccatcctctgtcatatatccaatgtctcctgtatgcaaccatatattaccatcttcatgcttctgaagagccttttccgttgcttcctctctatcataaccaagcatatttccaagacctgtcttacaaatctctccgagcttattataaccaacttctttatgtgtacctggctcaaaaatactcattactgttaatggcattggaattccactgtttccattaccaatcggatgctctaaacatggaagagtacaattagaacctgcctcgctctgtccatatccaattgaaagtactgccttacaattatgtgcttttaagaattcctgtgcacgacgaatctgtccattattgaatgcttcacaaccaacacctgctgcaaaaagatgggacatatcataatcttctggaattctgtcacttctcataagaagctcaataaacatagggattaaaggccagcagtttggacgatatctcatcatctctaaatcgagatcgttcacattacagaacggatctaaaattaataacttattagagcataatggtactaaaatcatggaaaccaccactgcaataagacaaggtggcagattcgtaagtaaccatgttggacggaagtctccagcagaaccataaaaagacatctgagcgataataccaatcattgtgtatgcagaatggataacctgcttagaagttcctgttgatccacttgtataagcacggaaaagcggacgattaacatctttctcaacctcaacctttcctgtataattctttcctttttctaaaaattcttcccatgtcataactccgtcccggaaagaattccatctgtatagaaagaatcaatttcatgaatgatatgttctggcatcttatctttttcagctgcatggtaagggcttaatgaaataatcgtttctacccctgcctgctttttatattcctcaacctctgcctttggaaggaagtcatgtacaaaaataatcttagcgccagcttcctttactgcatcaacgttctcctgtaatgtattatcacggcaaactaaagatgcacctatcttctctgctgctaaaagcaacacaataaattcaggaacagaacggtaaaatacaggaatctgatctccctctttgattcccatggcactcatagattttgctaccatatctaccttcacgaagaagcgttcccaggaaacatctcttccataataatgcattgctaccatatccatacctggacagttcgcttttaaatactcattcaaagacagctctggaacttgtaaccttgaaatactttctggataatacttcatccaagggcggtcaatacttggtcttccaataagttctactttatgatttttttccattttatatattctccttatcaaatagtatttttcttacactttatcgtatttaagggtaccatactttatgaaagatatcgagtgataaaaatggcaaaaaaacgaaaaacgtgattaaataaaatcacgtttttcacactttaaatttctttatctacttttttaagaagtgccactgactgtttcatatgttttagtatactttctatctttctccaatcagaaataactacatcttcttccgaatgactccatatttcctcaaaaaaacaacgaaacatttttttcgctatatttatattaagcaatgtcacgttattttgtatgtttttcgaatctaatcttaaataacacaagttatttgataaaaacaagcttggattggcgttgaattgaaaatccatcacaaaatgcccatgtatgattcgcagctccatcgcattttcttcatgaataatattttgtatataagaaagacattgttcgcgctgtcttgtatctaataaaattttattattataaaagtcaagttctccacttatcgcaaactgactgagtgctgtttcatataataaaattctgacatgagatttcttaagtacttcttcaaccaaaagatgaatattctgcatcttttctctttccgcatccgaaatatccagatattccaacagctctttatgtaattcttctggaaggaaatgctctgtcatatgtccaagaagccaacaaagattctcagataacatctgggagatatagtctgacccctgcaaaagattcctcattgtacattttcgaaacattaattcttctcttgtacaaagtgttgctaatcgttgataaaccgttttacacatttttttatcttcactaatcgttacctgataacacaaattgccccccaaaagcatactcgtaatacagtaagcatcttttgcacaaaatacaatcttatcataggaatgaatacagttgtatatcttaaaattaatatgcgtatagttcgtcagcatattaatgataaaaatacaatcataaatataatctttctcccctatgtcaaaattaatcagtaatgaaaaatgtacttctggaaaatctctctgaagaatctgtgatgccgtgtctatctgtgcaatctgaagtcgcacatcatgctccatatttaataaatcaatcgcagcaattacattcaacgactttacctgacgtaatgccggatgtgacatttttttaaggaattgatataatgtcagttttgcataattttgcgtttccggagcaatatcggctcctattgtttttgtcaggccttttacgtaaaaatattccgcctcaagattatcatagattgcctgcttcaaatcttctggcacatcaacctgatattcaatatataaagtttttagtgcagccgatgtcgccgattccacaatataatcactgattacatgaagaatctgcgctacacttttttctgatggcaatgtttttccattaatccacttacttatgtaagatacatcatattgaagttcggcagctagagttgcattctttaaattcactgttcccatcaagcgttctaataaaatgctaaacctatttttcttttccatttttccaccacacgttaatccaatacacaatttcacttagactaactctttccttacactaaaaagtgatgctgaaataagaatttcaacatcacttttttattatattcgtactttaaaagcgctcatatatcctaactattttgcttttacaacaacagttactttctgaactttcttagcacattttacggtaataactgcttttccagccttctttgctgtaatctttccagatttacttacaacagcaaccttcttgttagatgttgtaaatgtaactttattaactacagtgattggagcctttgttgcagtaagcttgtatgtcttaggacccttcttaaggtttaagttaaccttcttagaattaacagcaatctttgtaagttttactgctgccttctgaacttttactttacattttgctgtagcaccactcttcattgtgattcttactactgctgtaccaactttcttcgctgtaatctttccagacttacttacaattacaaccttcttattagatgtactccatgaagcaatctgatctcctggtaatgttgctttagcaaccttaattacgcttgtagacttcttaagctgtaatggaacagatgttgcatttaaagtaatctttgttggagctactgtaacaactgtcttaattgtcttgccactcttaacaacggctgtaatcgttacttttacagctttaccctttacaacaccagctttaataacaccagctgtgttaacagataccttagatggatttgaagatttgatggaaacaatgccatcctgtttgtagtcagaaacaagacttactttaccagactgtgttgagtaaaggttgtaagaagtttttgcaaattttgctttagaatctttctgagcaacttttacttctttcttcacaggatttatatatgtctttgttccttctggaactgttgctgttgctgtatatgttacacttcctgcttctgtatatgttgcatcttttccttcagatgttacttcacaagatactgtttcaacatgacttgcatcatttttacatgtaaatgttgcttcacatgtcatcttaccatctttttcagtccactcaccaaatgttggttcgccataatcatgaccaagtgcatttgttgtctttacttcctttgtatctgtgtactcatcacttccattaggatcttcttttactgttgctacataaacagccttaccagcttctgtacatgttgcatctgttgatttttctgcatccttagttactgtacattttacatcttttgtatgtgttttatcgttctcacatgtaaatgtcgctgtacactctttgccatcttcagaccagttgaatgttggttctccatacttatgtcctgttgctgcgattgttgtctctttcttttctggacatgtgtactctttacccttaaatgtacatgttgctgtgtaaacaactttaccagcttctgtacatgttgcatctgttgttgcaggtgttactgtacattctactgtctgagtatcatctttcttatcacaagtaaagattgctttacatgtcttataatcttcagaccattcatatgttggatctgcactataagtatgacctgttgcttcaataggtacttcttttgtatctgtatggtttatattattcttatctgttgctgttgctgtataaactgtcttaccagcttctgtacatgttggctctgttacttcagatgttacttcacacttttctgcttctgttgctggaatcttacaattctcacatgtgtaagttactgtacatgtattgtcatctgcccacgtaaactctggtttgtaaacatgcttttcagctgctgcttcttctgtagtagtagcttcgtactcgttatctccaactgttactttagctgtgtagataatctttccacccttttcacagtcttctgcttccttcttagaagttacttctacatccttctttgtttctaatgttacatccttctcatctaagaaatctaattcttttccaacgcaggaatcacaactaacagttacgttacctgtcttcttatcatcagataaagatgtaatctttccagtatattcgtgaccagtcttaagtccatctgggatatctaattcatcactattgtcattagagccacccataatgctaccactatttccactgctcttacgtggaatagctttcaaacattttgtacatacgattgcatctacaacaatcttcttagcatcttctgcgtcactttcttttgtataagtttcatctttgtactgaatataatgatgtccagttgccttagcatcttctgcctcggattccttcttagaatctgcttttacaacaccacatgtcttacaacgttcttctgtgaaccctgcattatcacaagtaggatctacggttactgtctcatactcatgagaatcaccagctacatgcttcatatccagagtttccacgaaatctgcactccacatgaattcctggttgtcattacttccaccacgtttaatggttgttccctggaacttatagttcatataaccactattgtaatttgtctgctctgtctgatacttatcaacataacaataatttgttgcaatatctacattcaggttgccctgagaatcaatagataaacctgcaattggatgattctctactgtatggatagcatctttatcatcctttgttgttactttaaaggtcattcctgtaaagttattattgataccggttcccatgttatctgcaacagattttgctgtaacttcattatattcttttacttttgtaatagcatttgtgcttaaatcatattttaaaatctgattatctgcattaagatataatgctccgccatagtaagcagatgtatgtgtaagacctggataaatcttatcgtttacatcttcatcctttgttgcactttctttaagaagatctccaccttcttttactgctccagtacctttttcgtaatcaactaaaactgtagcactgtcagatgtagctgtcgctgctgcttttcttggcaaggatactaactggtctggcttctgatcacttgtacccataccagaactgtatgaagttgtattctgcacataataccagttatctttatcaaaactgattggtccctgtgcatctgtaaaccaggcatcttcatacttagtatctgttgccttatctgtgtataaagtatcaatctcatcaaagttgccatcaaactgttttgctaaacttgtatggctaattaagaagtaggaatgtgtcatattaccgtctgtctctacacggttacgtcccatacattctacataaatatcattataacaggaatctacataataccagttatctacagaattatcggtcttaacagcattaaaataatggctgtttctaaatgtctggctttgacctaacatctgtacatcagaacgccagaaaatctttacaaagtcaacaatatatgttggttttgtttctgttgtagtttcatcttttttctcactggaagcatctcctgaggaatcttctccatctgcagcctgtgtttctgtttcagctgctgaagagctttcttccttatctgtctcggatgtatctcctttattctctgaagatgagttatcgtctttcttatcctgactgctgtcagttccatttacttcgcttgcctttttccatgtctttccatccgcttctttatagatttccgggaatgcacactgaacaagatatgtatatgcagaagtatatccagcacagatagtgtttcttcttactaatgcaccaaaggctgtactttcaaaggccgtcttaagatcgccatttaataacatatttctcagatatgcaatctgctcttctgtaggttgctgctgaccatcatctgctaatgcgacagctgctgtctctcccatagcctgaattgcttcctctgttgtttctgtatcattcttcttatcctgttcttcctgaatagcacccatatcaaaagtacagtacttaccaagccagtcatttaagacaagtaacttctgctctctcgtcatggaatcatcaatctgagctaaagcttcatctcttgctgcaagtaactgctgtccaaagagctgaataccatactgcagagtcgtctgatatccctgaatgacatcatacatatctttatatgtaaccttagcattcgccggattctcctcttcaggatccccttctttataaatcttctgctgcatcagagataacagggaagatactggaccacctttagaatccttacttgtaaagtaaggagtagcaatacctaaatactcctgattatctggtgattcatagaaagccattaagtccttataagcttgtccgacttctgtctttgtcttaccagatccatcatcctcatctgcatcatctgctgctaactcttcaatctcttccagtgcgtaagcataagtatcatctttttctacgctcatagtagttactttaccattcgcatctgtttcataagtaacgtctacaagatctgtatccttatcatcacctaaagatttatctgtcagcttttctgccttacgctctgtcagattatacttggataaatccacctcatctgtgttagtgtaaagtgcttcctgaattgctgcttctgcacttccagcctttggctgagctgccttcttctctgcttctaccttttcgtaagctgttgtagttgtggcatcttttaccgcatcatgaacagctgcaaaagcatccgcaggaaccaggcttactgccatagaagcagtcagaaaaagtgcaaataaattcttcacctgttttttcatacgtttctttctctcccttcattattttatatttccgaatgcatccagcatagaaatcatctgcatcccctaatataaatcaatacatctatattaaacgctgtaacctgccaatggtaagtagcagagcgtatgatttttaaaatccccaaaatcttattacatttttcttattatgtgataaacacctgacaaaggtatctcttgagtatcgtaccattttttcatatatattcaagtacattttgaatatatttccaaaaaattattttatcccaaattacgaattttaaagtctctttctacctctcgctttgcatccttctttgcaatatcctgacgcttatcatataattttttaccacgggcaagaccgatttctacctttacaaggctgcctttgaaataaacttttaatggcatcaatgtgtatcccttcatcttaatctgaccggcaagcttattaatctctgacttgtgaagcaggagctttcttacgcgaagtggatctttattaaaaatatttcccttttcgtaagggctgatatgcatatggttaatgaggatttcccctttgttgcttattgttacaaaagattctttgatactgcatcttcccatgcgaagagattttacttctgttccatgaagggcgatgcctgcctcatatttttcatcaataaaataatcgtgatatgcctttttgttattggcaattaatttaataccttctgattttgccatatcaattcccctttcctgtcttttcggtggataaccactcactcaatatatgaataaaactgtatgaatcgtaaattctggctatcaccactatagatgctatattcctaagcctgttaaattcattcttttttcttttagacttttattatattctttgcttctcttttttaaattctgaattagatttcgtcaatcttctttttattatataaatgcagtaacctgtctgcttcctcgtcgtcaatccagtcattcaaaagaatgccgtctttgtcgggaaggctctcacctgtttcgtcaaattcaaattcttcctgctctaccggatattctccatccgcagattcaaaattttcaaattttccggcttctgcatcctcattctttcttgacggcattccgtctccatagtaatcatctgggtctggatagtcgctatactgagagaattcttttaatataaagtcgatggttcgctccattttattggcagaatgaacgacaatttctgccttctgacctaatgtaaagattcgtccggtatgctctccggttaatttataactttcctcgtcaaatacataaaaatcatctaagaggctgataacgcttatcattatcatatacatgctgaattcctagcaaatgacataatccttctatgtagaaaataacctctatatttatcttattattaagttcatatttaaaaattttatgacacaaattctgttcataatattctaaaagctcttttaaatccttttctcttgcactcatttatttctccataaaaactaataggctatggaaatccacagcctattaatcgaatagcagattggttctcctaccccaatcaggtcaacttctgtgtatcttttaattccccaacagaaagggatggcatggctattcattacacaccaataatatcaggcatgatgcctattatatttatatgcaatatttaaacatttattacactttaataataacataatctcaaatttatatcaatacttctgaacatttatttttgtgccgtttattataaagcacttttgtcatattttcaacagctatttttattctttagcctttacttcccagttaatcatcgcctgatactgacattctggtatcttatcttttttctttgttttctcagccagctttataataaactccttctttcttttttcaaatgcttcatagcattcttcttttgtatcaaatacacctaaatcatgctcttctcctataatcatcataaaaagagaacttgcactgacacgctcctgcttgtacccccatgcttttttcgtcttaatataaatatttttccgtaaactatactctatttcttgtgtaattttattcctcttcccttttacaaattcgtatgttccatcttccttttttattacaggacgtccatagttggaaatccaagtgttatcataatataataattttacaaatctctcatgtctatctaaatattctagtttagcttctgtctgttttaagaagcggttgagatttattttcttgtattcccttcttatctgtacaagttttccattatcatataagctcatacctttttcttttaatgtgttttgtcttttctcattcctgcaatctttacagacagactgataacttgttttatattccttacggaatcccaccttacataatcgtctgttttttataaatttatttaatttaagctcttttccacaacaactacatatttttgtttcaatttcttttttcatgatatttcctcctgttctttcagagggcagaaacaccatagaaaaaatcaattatagaaaataaactgtatgtatttttaattatttattatggaaaatgttatgcgactgcatatagactcaatagacatctttctgtcccctgttcattgcaaaataaaagagcatccattactggacactctgtaaaataattatctttgttattgttactcttcttcggaataatcaaagtcttcctctgcttcattaagaccttctcctaaccgctcctctgttaattcctcgcaagccctttttaatcttgaatatggttttatgaccggtttatagtggggtggaactgttgccttacccttattgaagttattgtactgacgttcctctatatattctggatagatgccaagaataccttttacctcaaaacgattaccatctcttaaaatatcttctaagcaccagaatgcatctcggataatgtagtaaaggtcaatcttaggatacctgttatttgacttggctgcaaccatgtctataaattcttgtcttgatattgtttccattaaattacaatctcctttcgtattttttatgtatctcaacttgctactaaagcgtgtttgaaaaataatttttcggtaagaatcatataaccctgttcagataaaataaagcagtgtttttgacgattatttgttataaatcctaaaccctttgcaatgtttaaggaatttttatctttcaccaaatcaatagtatcaacaccttcaaagtgaccaaatgaaatttatatttcaaaatcagggtatctatagggaaatacttctttttatttgagttagattccatcctatgagaacgagtataagattggagatgcgacttctattgaatgccaaaacaagcatatatacgttcattttattaggcatatatgcttgttttgatattcaatatttaatttcagcataagcattatataaggatatatttctaaaaagtctactacctctatacgctacatgtgtggctatggcagaacacatcagtggtagtgaagatgcctttgtctccaaaatgaatgagaaagcacaggctcttggcatgaagcatacacattttgtaaattgctgcggattagatgcggacggacattacacaagtgcaagggatatcgccttaatgtcaagagaactgattacgaatcatccagacattttccattatacaacaatctggatggaaaatattacacatgtaacaaaacgaggggaatctgagtttggactttctaatactaataaattactccggcattatcagggcgcaaccggtctaaaaaccggaagtacctccaaagccggcttttgtttaagcgccaccgcagaacgcaatcatatttcccttatcgctgtcgttatggcatgccagagcgcaaaagagcgggtaaaagactgtgcctctttacttgattacggcttctctctctgcaagatttacaccgataaacagcctcccgcactctccaccatccccgtacataatggcacaaaagaattcatttcctgcaaatataagaaaaacttctcctatgtttttacttcggaaatcaaccaaaataacattcagaaaaaagtggtattccagaaaaatctctctgctccaattaagaaaaatcaaataatcggcagactggagtattcatataataacaaaaaaattgggcagtttctatattggcttcggaaacagtgggaaaggcaaaatatacagattatctgcaaaaactactactgaacttgtaaaataataatttcaattcagcaaaaaacagctcccaaagaaagaagctatcctatattgtggtcttagagcgtgtctgaaaaatgctctagagtgaggattgaatgtgagccattcagcaaacattcaacccacagtgacagagtcacaaatataggatagcttctttctttgggagcgtctcctcttatcttcacaaattactatttacaaaatatcaatatgttctccagccaatgccttattcatgcttcttaccgcacagaactttccacacatagagcaagtatcctcatgttctggttttctgtcatcgcggattgctttggctgtttccggatccattgcacattcccactgtgcttcccaatctaaaacacggcgggcatctgccatcttatcatctatctctcttgcaccacggacaccttttgcgatatcggctgcatgtgccgcaatttttgatgccatgattccctgttttacgtcttcaagatttggaagtgcaaggtgttctgctggtgtaacatagcagaggaatgcagcaccattttgagcagcgattgctccaccgatagcggatacaatatggtcataacctggtgcaatatctgttacgattggtccaagtacatagaatggtgctccagaacaaatggtggactgtaacttcatgtttgcagcaatctgatccattggcatatgtcccggtccttctaccataacctgtacatttttctcccacgcacgtttggtaagttctccaagacgaactaattcttcaatttgacatacatcggaaccatcggcaagacagcctggacggcaggcatctccgagggagattgttacatcgtattcctgacagatatcaagaatttcatcgaaatattcatagaaagggttttcttctcctgtcattgtcatccatgcaaatacaagggaacctccacgggatacgatgttcatttttcttttatgctttttaatctggtcgattgtctttcttgtaattccacagtgtaatgttacgaagtctacaccattttctgcgtgaagacgtactacatcaataaagtcttttgcggtaagagtatctaagtctctctgatagtgaattacagaatcatagattggtactgttccaatcattacaggacattcggaagtcagttttttacggaacggttctgtatttccgtgggaagataaatccatgatggcatctgctcccatgtttactgcttccattacttttttcatttctatatcataatctttacagtcttttgatacaccaagatttacattaatctttgtttttaacatagagccgacaccctgtgggtctaagcatttatgatttttgttcgcgcagatagcaacttttccttctgctactaatgctctgatttcttctggtgtcattcgttcttttgctgcaaccttttccatttctggagtaataatattttttcttgctgcatccatctgtgttgtgtaatttctcatcttttgttacctccaattttgtaaatactatttataatgccatttttataaagcttaactaatctgtttatttcattactttatatacattgacacttgtctgttactatgtttacaaatcccacatatgatttagcgggccatttccctgtccaagattcagcattgctctaattgctccgctgatgtatacttttgccttttttacggattcttctacaggaaatccctttgccagatttgccgctaccgcacttgaaagtgtacagccggttccgtgtgtgtttggattatcaattctttcttctggaaaccaaacggctttttcttttttttcttcctgcaaaaaactctcataaagcaaatcgtccgcattttcttcgctgtgaccgcccttacttaagaccgcacaattccacctgtctgcaatgacttttgctgcttcttcccttgtttttttatcggtaatttttatcccggataaaaattcggtttctggaatgttcggggttagcagggaaacttttggatataatttctcatataatatctttctcgttgtttcttctactaaaaccgtaccgcttgtcgaaatcatcaccgggtctgccactacatttttgatagaatatttttccaggtattctgcgataatctctgcctgttcctttgaagcaatcattccaattttcaccgcatctggctttatatctgtgaaaatgctttccatctgttttttaaaaaattctgctggtactggcataatcccggtaattccgactgtattttgtgcggtaagtgcggtgatacaagtcatggcatatactttatgaacagttaaagtcttgatatccgcttgaatacctgctcctccgctcgaatcactgcctgcaattgtaagaactgttttcatatttgaaaaagaataatcacctatctccgaaaaatctctcacataaatattagaaagtttctggatttctttcgcatttcccacactgtaggtatcgtagatactgcatactggaaatccagcttcagtagcagttttcaccgcatataaagaatcttcaaatacccatgtttcctcttttttagtgcctagcttttgccttgcaagctcaaataccttcgggcttgtctttccggctccggcttcctcgcaggtaatcattcccgtaaagtcctgccatatgccgttacgaataagcgccgcctttgccatctccttatctgtcgctgtggctataattaacttcacaccattttctttcagacgttttactaaggcataggctcccggcttcatgaccgcttctttatagtaaaaatcttttacaacctgattgactccttctaaaatgtcttctgctgataccgaaaggccatactctttttgcatatagatggctccttctggcaaagataaagcatccagccgttcttttaaatctggctttgccttaatgccaagagtagcaagatatctcgctcctgcattttcccagatgggcatggaatcaagtaaagttccatcaatatcaaagattgctccttttatcacgatgcctttctccttttattgtcttttccactaactaccgaaaaattatttcagcattttttctgttctgtcttttaaaacttttgtagcagcttcaatatcttttgccgcaaaaatagcactaaccacagcgataccgcaaataccacttccctgtaaagataaaatgttatctgccccgattccaccaattgcaatcactggaatatttactgcctcgcagattgcttttaatgtttccttgctgacatctgccgcatcttttttcgtggaagtggaaaatacggctcccacgccaagataatccgcccccattttttcagctaatactgcctgctctactgtctgggcagatacgccaagaatcttgtcttcaccaagaatctttctcacgtcatcggcttccatatcactttgtccaacgtgaactccatccgcatccatatcttttgcgattctgacattatcattgataacaaatggaacatgatagttatggcacaattctttgagagccaccgcttcttccatgaaatgttcctcatcgagttccttttcccgaagctgtataaaagtcgctcctccttttaatgccttttccacctgctcgtaaagtgtttcatttccaagccaggaacggtcggttactgcatataaaagtaaatcttttcttaattgttctctgttaacgcagctcatactttgctctttcctccaatgtatttccatccatatggtaaatagcatcaattatccgattacggtaagtggaatttccctcaccttcttttaaatgttcaaatccaatctctccggcaattcccatcgcacaaactgccgccgctgctgcctccaaaggctgctctgcgtttgcacaaaggaaagccgtcatcattccagaaagctggcatccagttccggtgattgctcccagctctggttttccgttgcggataacataacatttttcagaatcagcaactaaatcaatggctcccgttacagcaatcacacttcctgtcgcttcagaaaatgctttcagcttcccaatcgtctcatcaagattctcctctgtaaccgcatctgccaaatctgcatccacaccttttgtatttcccgttccttccatcagggttcggatttctgaaatatttccacggataacagtaaactttatgtcccgcactagctcattcgctgtctttgtccgaagtccactcgctccggctcctaccggatcaagcagcacaacatgaccaagtacatttgccttttttcctgctaaaaacatggacggaatcgtatttttattcagcgtaccaatgttaatattcaatccctgacaaatagaagtaatatcttccacttctccagaatcgtccgccataatcgggctgccgccacaggcaagaagaatatttgccacatcattcactgttacatagttcgtaatattatgtaccaatggatgcttttctcttacgttatcaaaacactgctttaacatttttaccctttctttacatatagatttagcatatatattcattcaagaatgctccggcattgttgctcgccacctacagaggttggagtcatctcacatctgatatatatttagcatgtctatttatttttcataaacgggaaaaaactgaaatcatcctatacttcctgaagtgcgttttgcaaaatgctcagaagtatatttgagaaatattctgaatatggataaataaacgataaaaaataaaagaaaatttataaagattcaatgtagattttctcttaaagcaatttattttaaaatgatttactctgaaaagaaaaacgcatatacaccaatctcggtatatatgcgaatatatctacgctatccctacgttggcattatccaaatcaggttatgggtctaagcactttagcttactctcagcctgcttctgcaagctccccgtgtatgaatttaccaatatagtacgctatttgagtcaaaaaatcaagcataatttactatttaattcattaagagacagacgcccggggagagaaccgataccctatatttgtgactttagtcgcggcggtttaaatgctcgctttatgcgctcgcatctaaaccttgctccgaggccacaaatatagggtatcggttctcttcccgggctgtctttggctggattttgtttgaattaaatagtggttgtggggatttgagggaaagggtagaagttttctgcttgctttcaaaatattgtagatagatattttttatcccactttgattcgtgtatcttttattgtaagctgctaaaagattattcgtaaactattattactgattggatactagattttaagcaaattgatataattattatgttatcatccgcaatatttataaaatcaaatttaaaatgccgatttcttcattttactattacatataggcaggtcaaatcataccctctgctaccagtcattgtcgagtaagcagaatacatcagcttctgtccccaaatcccctccccctgtttaattcatcttctccagccacagcacagaagccattgcccccaataaggcatatttgtggtctcggagcaagtgttggatgtgagcgcataaagcgaacattcaacacgccgcgactaaaatcacaaatatgccttattggggcaatggcttcgtctgtagtgtatctaatgaattaaatagtaactatcccaatgctacatcaagcgtcagcattagtgtaaatccaaaggaaaataatatcgttccaatattgctgtgttttccagcagacatttccgggataagttcttccactacaacatagaacattgcccctgccgcaaaacttaaaaagtatggcagaagcggaacgataaggcttgctgcccagacagtaaacaccgccgccactggctctactgccccggaaagtactccataaataaaggctctcttttttgacattccttctgtacaaagtggcagagaaataatcgctccttccgggaagttttgaatagcgattcctaatgcgagggaaaatgctccgatttccgtgatatgctctgccccacttaacagtcctgcataaataacaccaactgccataccttctggaatattatgaagagtcactgccagaagcagcttatttttacatttttcatcaatacattctggtggtgcaaaatagtcgattgccattaaaaataaaattccaatccaaaaaccaattactgctggaaggaacttccacataccaagcgaagccccctgttcaagtgccggaagaagaagactccagatagaagccgccaccatcacacctgctgcaaatccagttaatgctttctgcattcctttactaagttcattttttaagaaaaatacacaaaaagcacccaatgtcgtccctaaaaagggaacactgatgccctttactatatctataatcataaaatgtctccaagaccatatttgttctactatttaaatatgtcctcaaaacaaaatgtttcttgttactatttaattcattaagaacagacgccgagaagagatacgatatcctatatttgtgactttagtcgcggcagtttaaatgctcgctttatgcgctcgcatctaaaccttgctccgaggccacaaatataggatatcggttctcttctcgggctgtctttggctggattttgtttgaattaaatagtagttgtgggatttgggggagagagtagaaattttctgcttgctctgaaattattgtgaacagatgctttgcatttaaattaaagttataaaagttgaaaagggaaattgaagcttacttcttgctccaatataatatagtcaagtcaaatcatcccctctattcccagtcattctcgattaagcagaatacatcagcttctgtccccaaatcccccctgtttaattcatcttctccagccacagcacagaagccattgcccccaataaggcatatttgtggtctcggagcaattgttggatgtgagcgcataaagcaaacattcaacacaccgcgactaaaatcacaaatatgccttattgggggcaatggcttcgtctgtagtgtatctaatgaattaaatagtaactctcatatatgcctgctcatagaaaaattcctgcgaatttaatggagtctcctgtgcctctgcaatttcataattaccgcggctgtcctcctgtctcgtttttggttatcgcttaacatcgtgataaacatctcttctaattgcatctttaaatctttatcataaattggcgtcgcaacttccactcgtcttaatgtatttcttgtcataaatctgcagaagctatgtaaactttttcccgctcctgtgttccaaaatataaatacggaatgctctaaaaaacgtccgacaatgcttcgaacctgaatattttccgtcttacctt

SEQ ID NO: 14 - DNA, 16283 bp, Eubacterium hallii WBS-01
ctccctggcttcctgttgttataagcacgagctgctcatccacataattcttcatctgttctatatcgatcaatgtgttatctggaatcttaatatagccaagctctgctgcagtagagattgtgctgaccatacttcttccctcgataacaaccttctttccacaactatacgcacagtcaataatctgctgtacacgatctacgttcgaagcaaatgtcgctacaataattctgtggtctttattctcatcaaaaaggtgtcggagagttcgtccaacggtcctctcggatggcgtatatccctcacgctctacattggtactctcacacattaaggcaagaacacctttctttccaagttctgcaaaacgaccaagatcaatggcatctccaaataccggtgtgtaatcgatcttaaagtcaccagtatgcacaataatccctgctggtgtataaatagcgagtgctgccgcatcactgatactgtggttcgttttaataaattctatacgaaatcttcccagattaatagactggccatgtttgatgacctttcttctggttgttcttaaaagattatgctcttttaacttattctcaataagtcccattgtaagctttgttgcataaataggcatattcagttctttaagagcatagggaatcgcaccaatatgatcctcgtgtccgtgggtaattacaagtccctttacctttgaggcattctctttcaaataagtgatatccggtataactaaatcgattcccaacatctcatcgtccggaaaagccagaccacagtctactacaataatactgtcctcatactcaaacgcagtaatattcataccgatctgctctaatccgccgagaggtattatctttactgattgatttcctgttactttcaaattctaacctccgttctactattcacttgtctatatagcagaaagcacaatcgcatagaataaaacggacatctattcctgccaaatatctgccgttttatctcacacgaaagcctgcctgctattctacttcaaaattaatatcgtccattaactgctcaaatactttggatactgatataagttcttcctcgtcttcaaccatctcataggttgcccattcttcatcctcagccgcatcagcaactcttttcatgataagaacttcaacctcctcgtcatctgcatctgcacttccgtcttctactaacagatagtgaaatccattcagagttgtctgttcgaggacatagaactccttttcttttccatcttcgtctttaaatggaatactctgataattgttcatataaaacctctttcttccgtacttacgtccgttctccgcttacttttccggaattggatgtacatccatgtaactttgcagaatcagagtagccgccatccagtcaatgcgttctttcctgttctcacggcgcactccgccttcctgcaaaattctctctgattccatcgtagtcagtctttcatcccataagactacttccaatccggttctgcgctgaagcatcgcctgaaactccttcgtctcctcagctctttctcccagcgtattattcatattctttggcaatccgagtactatcttactcacttcatattcttctatgagcgcttctatccttgccaatgtctggcgcagcttcttattcgactttctggtaactgtctcaactccctgtgccgtaatacccaaagcatcacttaccgccacacctactgtctttgtcccgtaatcaagacccatccatctttctttcataattactttaactgagtatcaatataattttcaaataaaacttcaagaatctcgtcacgttctaccttcataattaagcttctcgcattcttatgactggtaatataagtcggatctccggacataatataacccacgatctgattcactggattatatcctttttccgttaatgcttcgtatacatctttcaaaatagatgctacatcatattcctgttctttaaccacatgaaaaaactgtgtattatttctacccatgtctacctccttctagcagatttacaatcaataaatattttactatgagtgacattaaaattcaatcgaaacttttccgtacagtaaattttcatcaataaatccctgaatatctactacaattacctcattttgttctaattttgtatcattttccgttaattccactgcaactttcacataatgagccgtatatccctgaaaatattttttaccatttttctctacaatttcttctaaaagtactttttcttttcttccaacataccattcttcaaatgctgtcttgtgcctttttgccatcgaaagaagcacctcggaacgttctgtctttacctgttccggcacatgcccggacatcttctgtgctcttgttccttctcgtacagaatacttaaaaatatgcatctcatatagattgattttctcaagatatgctcttgttttttcaaattcttcctcagtttctccgacaaaacctgcaataacatcagttgttaatgccggatgctcatagtactttcttaaaatatttaatgcttcctcatattcttctgttgtatatttgcggttcatacgctttaatgtctcgtcgcagccgctctgtaaagaaagatgaaaatgtggacatactttatcacatttcacaagttcttttacaaactcctctgtgataattctaggctctaaagaacccagacggattctctccacatcctctacctgctgtattctcttaatcacatcaagaagagtcactgttcctaaatctttcccataggaacttaaatgaattccggtaagcacgatttctttataaccctgtgctgccagattttttacttcttcaatgacttcctctggatttttactgcggattcttcctcttgtgtaaggaatgatacaatacgaacagaactgattacaaccatcctgtattttaatatatgctcttgtatgctcgtttaccttatgaattgttaaatcttcatattcttttgtgtgattaatatcaattacttctgagacaactggtacctcctgctctggttcttttgccgcaaaatattcctcaaggatctgggcgatatctttctttttattattaccgacaagaatatccgcctcatttttctttgctagttcttcctctgctgcctgcacataacaccccgctgccacgataattgcatccggattgtttttctttgcacgatgaatgaatcatctgacggctctttctgtctgccatatttgttacagaacaggtatttataatatagacatccgctgtctctttaaaactgacaatctcgtatcctgccttttcaagaatctcctccatggcatcagtctcatactgatttactttacagcccagtgtaaggaacgccgctcttcttttactcataaaaacaaatctcctttttccgtttctccttttcgttttttctgttatttattatttcctacctgcaatcctattttttctaacttcattcatctccagattcatgccaaaaaattcccctttatctttagataatattttccaaatcttcctcaaatctattgactttttttcactaaaaaggtactatattattaaaatatatatagacatttttaggaggagcgcgtatatgaaaacgattaaaatctctttaaattccatcgataaggtaaaaacatttgttaatgtcatcaatcgtttcgatgcagaattcgatttagtttccggtcgttacgttattgatgcaaagtctatcatgggaattttcagtttagatatttctaaacctatcgatttaaatatccataacgctgataatcttgatgagattatggaacagttacagccatacttagtaactgaataattacataagagcgggttttctggtatacggatatattatatataacctgtgatgtatttatgaaatcaaccgaggaaatattactttcctcggttctttctttacagataaatttttcttatatgaatcttcagataaaacaaatatttttagtgatatttcttcttcccaccttttaaaaaggcacttatctgcaagcattataaacattatcaaaatacttatgtctgccttgaaaatgctttcatccattaatactttagtgagcgttaatcttaatttcttctgttgtttcaatcgctgtcttcatcagctcgtcaatacaatcatcaagatttctctcagaacgcttaattacatctaatcttggctttgttaccggatgttttgccacaaaaatagtacagcagtcttcgtatggtaaaatagatgtctcatatgttccaatcttttctgcaacttttacgatttcatttttatcaagtccgatacaaggacggaatactggcatctggcacacttcatttgttacataaagactgtgcattgtctgactggcaacctgtccgatactctcacctgtaacgagggaaagacaattatcctgatttgcgaaatgctctgcaatcttcatcatgtaacgacgcataatgattgtcaattcatcatgaggacatttctcataaattgccatctgaatatctgtaaagtttacaacatgtaatgtaataggtcctgtatattttgcaatctcttttgcaagatctactactttctgtttcgctctctcacttgtataaggaggtgcatggaagtaagttgcgtcaatgcttacacctcgcttggaaatcatgtaaccagctaccgggctgtcgataccaccggaaagaagaagcattgctcttccgtttgttccaacaggcattccacctggtcccggaatctctctggaataaatgtaaaccttatcacgaatctcgactgtaagcataacatctggattatgcacgtcaacacttaagtcctcaaacttctctaataatctctctccaagacgggcagctgcttccatagacggaattggatacttcttgtctgctcttcttacatgtactttgaaagaaaaatgcttatctgcataatcttcatctacatatttttctacgacttccgcaatcttttcaaaatctttatcttcttctactacaattggacaaatacctgcaataccgaatacatggcttaagctttccaccgcctcatcaaaatcatactcttcattggcatgtacaaaaacgtccagattcctttctgatagaaaagtctcctactggttttaatgcatatttcatctgacggacaagggcatcttcaaagaaacggcgattatttcccttgattccaatttctgcatatttaatcaaaaatgctttgaattccataaatatctccttttttatatgatgtactctcgtagtctttcttgtcacaaaatcaagctcaaaaagattccgagagtacattatgttctaattgttttatcgtcttgtaaatctccgaagcatcggcaacagttcttttaacgcttccacacaaatatctgcttcttctaccgtattaaaaatagagaatgaaaaacgaagcgtcgattcatagtattcctttgtaagaccaatgcccttcaaagtaccgctgacttccggtttattagatgaacaggcagaacctgctgatacataaatctcacgttcttctaatgcgtgaagaagcacttcacttcttactcctaaaaagctgatactcgccacatgcggagcatctccggaattatctttcacatctggaatctcttccatcactctttttataaaatgatcttttatctctctgatatgtgcgatcttttcctcatgattctcataaatcaactctgccgccttaccaagccctgcaattcccggtacattttctgttccggaacgcattcccttctgttgatttccaccccagatgattggctttatctttgttccattcttaatataaataaatccgattccctttgggccgtgaatcttatgtccacttacagaaatcatatctgctttccatttcttagggtaacaattcaacttaccatatgcctgaatacaatcggtatgaaataaaatctttggatcaaaagactttacaatctttccaatctcctcaaccggttcgatggcaccaatctcattattcacgcacataatagaaaccatcaatgtatctttacgaagcgccttctttaatgcctctaaatctacgattccatgttcatcgacaggaagataggtcacttcaaatccctcatcttccaaaaaagataatggattatatacagaagcatgttcaatacagcttgtaataatgtgctttctctctcttttatttgcaaatgcagtaccgatcaatgcaagattattcgcctctgtaccaccagaagtaaaataaatctcctttgaatcaactttcaggctctttgcaataatctctttcgcatgattgacatacttctctgcatcaaatcctttcatatgcatagaagatggattgccgtactccttctcaagtacttcatccataatctcacgcacctgcggcagcgctcttgtggtcgcgccattgtcaaaataaatctctgacattctcgtttacaactccttcaaaaaatatattatgtcttattgtttttttgttccattctctacactcaaaaaacagccataaaaaatggcataatcgtatataaacataacataaaatgagagagaagtaaaatggattttgcggataaacagacgaaaatgaaaaaggatactcccctcaagctgtaaagatagtcgttcgagcaaaatgctcagtcgcattttcactcactccgacattacatcttgaggggagtatcctttttcattttctgtttgttggctctccaaagtcattttactggctgttagagaagaagtggttaaaaaataataactttaagctttatgattattttatcttatatgactactttaccttgactttaaaggttgcttttttgttacttccgtcggttgccatcgctgtgatttttatagtttttcctttggcaacctttttagttttgactacgcctttggcattgactgtagcatatttcgcgttggaggatgtccactgtaactttttattcgcttttttcgtagcggttacgttcgcttttaatttcaggctttttcctgctttaacagttttagttcctgtaatttttaccttctttacgattcctttcatggaagttactttccaggatgcggaaacctttatcttatcgtttgatgctgttattgtaactttctttcctccggttttctttttcactgttacaacaccatctgcgttgacagttgctaccttggtattgcttgacttccaggttaactgttttgttatgctgtctggcagcccgatttcagcctttaagttcacctttttgcctgcggcaatctgttttggctttccggttgctttaaaaggttttatagatggagcatttgttgtgttaccagatggttttgttgtgttgctggacggtttctgggttccctgatttgcattttttgaaaaatgtgctgacaggtttctgttattctgaacacagaagcggtattctttttcttttgaaatcagattatcattttcataccatcctgcaaatgtataattagtttctggctctgcagttacctttgcatattcgctgatcgtatagcttccgccacctgtaacacttccacctgactgcgcagtaacatttacctgttttttaatatcttcggaagcacctttttctatcgaaggctgtacttcatctccactgacatttttaagcgtttctgtagaactttctgtatctgtttcaaatgtacttttgtaaacttctccttcttttatcggaatatcaacataactttttacctggctacattcattagtttccagattctgattcataacggtatatgtcattgttccgttatccgttgcttttaaatcctctttgtagtcagcatcttcagggatacatacgattttctgaccattttcatcaataggtattaaatgtgttagcaaatatgcattatcaagaggatgctttgcagcaagtcctggtatcactcttgcaattgtcactgcaagggctccggtatccaatccactgttctttcctaatactcctgccattccactaatcatatttgcctgcagcctcatataataattttctctattcactgcaacatcgcataaatcatccatcagcttatccatcatagaagcctgcgcaagcccttctttcgttaaatataccaccgcctgcattggaagatataagtttttcacttctttctccgtccaatcatacattctcgctcctagagcgtgtttgaaaaacattttaagttgttcattttaaccaaattaatattgaggcgatgcatataaatgctgcaaaagtggatgctaatttatcataacgcgtggctattcgacggaatgcttttaacttgagaaaatagttttccactaaatgtctttctttgtaaagatgccagtcacagtaacggtcaaatttagccccttttctggaaggtatggttggctcaccaccatgggcatagatatagtccattaatttattgctatcatatccgcggtcagccagtatatcactttcctttatgtcaacttgttctagcaaagggatggcgtaattaatatcattacgctgtccctcactgagcataacataaacaggataaccataagcatctacaatggcatggatttttgtacttgctccaccgcgactgtgtccgatttcgttggatggccccctttttttgcacctgcactatgttgatgagcctggacaatggaggcatctattgataattcgcttaattctgcatcaaggcttaaaacacgaaagatattatcaaggataccgtcttccatccacttgcgaaagcgagaatagacagtttgccaagggccatagcgttctggaaggtcacgccaaggtgctccactgcgggcaatccagacaattccgttaagaatggtacggttacacttggatggtcgtccttgtttgccagaattttcaggtggcagtagagaaacaatttgattccattcttcatctgttaattcatatcgtctcaacataataaactccccttttttctttattttatcatgaaaaagggcgtgggaatatatgttttgtgcaacttttatttttcaaacacgctctaggattaaaatgtcatctgatgtagagataagtgtctgaaatatctctgtcgccttaatcaacacggatttacctgaacctgtatgcccgacaatgattgcgtggggattcatcagtaattttctattgccaaatatcagacgttttgttgtcaggtttaatccataaaaatacccgccggggtctaagatgtcctgggcaaagtatggctgcatcgcaaccatcgaggaagataggaagaaacgcatataatcgacctgccgtccggcaaacggcagtgccgtatttaatgcttttaactgtgtgtaatccgccgtactgatgactacaccctgtgcctttcctgtttcttttaactgctctacccgttgtgctaatgtagattcatctggtgcagttgctacgaataaaaagttcaggaaaaatcctgtctcatcgttatcgttcactaaatccatgtatccttcaatctcatctttctttctctgttttgcataagatggtccagatacgatgatatttttctttctttttgcttcttcttcctcgctgatggatttctcattgttcattgccgcagcgatcagtttttcattgataacatctgccggtactggcgaaaaatccagcgtaataaaagatggaaaatcaacataagagaagctacgcatcagttcatcaggtttcagtgtcctgctgtatttccagccgaacagtacggaaacatactgcgttttatcaaatatcatgaaattggaatactgcctgatcgtctgcggcatgacatcattcttccagtcatgctttccactctcatccagatagatatactgttcttcctcctttttgcctggacggagtaatgagtgcagacatttcagacgttcttcgccatttaaaaggattatctttcctctccatttggcgaacatctgctggattgtagtatccagagcatttagtaaaatggtcgcttcatctaacgaatttgcccggcacgaaaccgtcagataacgtagcgttgttacattcggattagaattttctaatttttcccttgtccattcctttatcccctgtcaatctgcggatacaccttactgttctgctttccacggattttttttaggaattcatcaatactctgaaactcatttgcaatcgtgatcttaaaatcaacactcattgatttcagccatgacataaactggttcagaaaaatatctttttcgctttcatccttgttaatatagttaatctcctcaaaaacataacatctgtcataaatactgtttgtttttgagggttcaatctttgctatcccgtttttatacatccgttcaatatttaatgcctgccgcacattcttcgggacaggaacgatgggaacactcttagaatgaaaagagcggaactttccactcgcattgataaccgccacgttgattcctcctttaatcgaaaagagccagaaactttattttccggctctgtccttttattatttcttttttctctttttcttttttacagcaggatgacgcatggtaaatatcctgcctgtcttcggagcttcttccgccccataagtaagttttttggttgtcctgtaaaaccgcatctctttccacatttcccataacgaatggttctggtactcgtaaatgccaaaaaaacatatcgggagcatcacaggaatggcgatataactgcctgtgatcggtgagattttcatgaacttccacagtgctgctatcgtgcctgccgccataataattccaatcgcaaatgtgatgatctgctttagtgtaaaacctttccagaggtcgtctggaaaggctttttcaaaatccttgttaatatcaatcttcatttcatatcctcatcatttgtaataaaaagaaattcttctgtttccacatcgtttacatttctgagttttctgatattggaactttttccctcgtttctttcctgtttttatactcatccctttattataagaatgacctaaagccggtaattctttataacttaaatagcttccacagatttcttcgtcaccgtaactcttagggcatccttttcttgtacagacaatctctttatgtccccagaaagacacgttggatgtaaaatcctcggttttcccggtttatgtcctaacgctggtgttttcattatcgtttggaaccattcttttccgcaggatttacactttttatatgaccttccccggtattcacaggtaggtttggttaacgtttcccagattatttttttatggttacacttttttgcctttgcctgcgtactgctccccggtacaagtaccagcactatgagtaccattaaaaccacagcaatatgtctttttgtcttcataatctttcactcctttttatctgttttcaagatccatcatggaaaataatagctccagcctccatattcattttttaacttaactccgccgcatttcaaacagtcatatcttgttctcttctttctggtaagtttccatttgtgttttgtcttagggatcactttttccagcaacacttttctgcatctcacacaaagttgttttttccttcctgtatgattacagtttgctttttctgcaatgatccacgttctgcctgtatgtttatgattacaccctgcttttgcctgtgcatttgcaaaaaataccatagtcatcattatagccagtaacactatagttacttccttttttaatttttccataaattctccttgtatcaaatagcatgaagtttctctttccagctatttaacataaatcgtctctttctttccacatctgctgcatatacgtgtctttttcggtttcttttttatcatactatcggtatttaacttccacttagtccagtgatgtccaagagctttcccttccttatgagttgacttgtacttacaattcttacatgaagttacaatcgtttttggtgcagtacaggtagccttgtaagttttagcaatataggaatgtcccaaaggagctatcttttctgttttgtaatatttcctatatccataaatacaatctggatttaaacaatacgttgccgttaatcccggttttgtgcatgtaggcattttttctatttgtgtgcgtaagcagtgtcctgatttttttatcttctttatctttaagatttttccacagttcttacactttttaaccttcatgccttcatccgtacagctaggttttgatgttgtgatccatgttacacttttatgattacatttttttgcttttgcctgtgtgctgactcccggtgtaagtatcagcatcacagacaatattagggctattgtgataactctttctattttagctgcaaattttcccatgatctctcctttcccgtaccgaaatccggcacatttataacatttataatcccatcgcctttgacagaaatgcattggaaccttttacggctgcagttacaaggatcatagtaaacaggctgtttaatgcatcccagaacccatctaccatagatgttgcaatgttttttccgtcaaatagcgagatgcctgcaccgatgagcttgaaagatatgaccatcgttaaggcaatcactacaatctcaaatgcatttaacaggaatgtccgcatccatgcatagaaactacgctctatctcctgacctcctacaagtgcagacatcgcaaagggtgctaatatcatgagcagatatagctttatgtaccggctgtatactgtccataacatcaaaaactgcaaacgatcgctgccagtataaagagcaagccaaatagctgataaaacaatgctgagccaatatccatatcctctacttttaaatccggggcatctatcgtaaagacttctttcgccatcgctgatgagatagaaaatatggttgtcattatatttaagatattgagatacaagacatttgccacgaccaccttgatcattgcttcgatgaccatctccagtgtgatgttctgatgcaggttactcacagctttcaaaaaggctatcataaaaaataaatttagagcagagagtccgatcccctctgcccacggatacaggttttctttgacaaatgcccatgttcctgtagaaaacttttgtggcgtactgcagaccagctttatgatcagcttcatgctggagttccagattgctgccgcaatctttattgtcggaccagagagaaagtcaaacagccattccggcataaatcatccctcctgtccttattttaaagatgcactgataacagtaacgatctgcggggcaaggcaggcaactaatccagatgcgatacgtttaaatgccatcgactgcattgttccatcctgagagtttaaagccgttgcccattcaaacactccccataacagtaataactgtccaatactgctcacaatcgctgctacgatctcatacagcgaattaaatcctgatgtgatcactgaggttcctgctgcttttgccgcatacacaggcacatacatactgaaataacaatatgcagtaaaaaaagccgggacagctctctttactgtcctgactcctttttctctcattgctcctatgaagttttttactctgttcatttgcctagtcctcccgatgtgatttgtaaaaataatgatcaagatgataccgacggatattacgatctctaacagtgtcgctaacagacccgtccaagcctgcattcctgctggtaacagtctgggcaggatagcccttgccgccagatttgccaccagcccaacaataaatgcgatcaggatgataatatatttcttccagttatttcttctcacttatgattcctcctttaaaggcagcaggcgtttctttgctgcttcttttcctataatatctgtaaacagacgctctgtctgttctgtaccatctccggcatatttatataatgccgtttcgtaatccttatacctgctcgtatacaggtaggatattgccgccttaaaccttttcttatttttcctattacggctctttttcaccgccagatgaagcattccctcgattgaatctgctgctttataacaattaaataataagtgtattgtctcctcatcatatactgtcctcggtaatttttttagatatgccggctttgacctgatgataaaaaaccgaatagcaaccacacctattattaatactatcaaaactgcttctgcaataagcatcggtttcggaacattctctactgccagtataaaatttttcattcttcttctcctgtatctgtatcaaaataagtatcaaggagacggtctaaatatcttaaaagttcttcggctgtctggtctttatcaaaatctccttcggctgtaactgtgttatctgatgtatcatatttaaatgtaaggtcattctgactactattccagctacggattaaccggcgtaacttacggttgttatttccaatagatttcttaatatcaaaccagccttcttctgcaaaaacaactgttactacaatctgggaaatagcaatgttgaccatatcaccctgttttgcatggcggagctggataactccgcctacttcctgttcctgcagataattataaaatccttcggctgtcagcggggtatccatctctatcgcttccttcaggttttcttcttcctttgcatacacagattcttcttccgggactacttctacctcttccacttcctctacagcttcttccgcccctgatattctttcttctacaggttcttccgccttaccgggaacatcctctttcttctctggaatgctttcatcctctaccccatcagctttttccaaagctgtgctttttctttattcagggtatcaatctgtgagacaaacccactctctttttcttcccattcgtcagctttatcttcccatttttcaatctcctccttaagtttctggatttcctgtgcttgttcttttatcttctgttctttttcttctaagacaaccgggtcaaagttatcagaagaatatcctaagtcagccagtttatcttccagttcccggctaagcctcgctgctttaatttttcattgcgaatttcttctctaagaatggaagtatcaagtaaggactgctgttcgtctgcttctaactccaacctttttttctgcagatacttttccatttcctgcgtttcccgctgtctttcttcgagcatctgcatcttttcttctatctctttttcctgctgtcttacattttcttcacgattgttaaactgctcctcctgtttctttaagctgttttctttctgttttacagcttcttcacgcatacggtttctttcttccatttttttgtattccgcatcacgctctgcaaaaatcttttccatcttttcaaacaaagggtctgtatttctgtttaataattcactcatcttattatgtaccgaaattcggcacatcctccttccttaaaatttatctctatatttatctggtctggtatatctgcttcttcctactcctaaaagcggcgcaaagataaaaggcaaaaacatgattcctactgtataaccaaatccatgtccaaatgctctgcttaaactataataaagcgttaccgtcaatccaaatgctatgcttggtagtacaaactgcagcgtatctaaaaggacacctgcatttaatgttacagatactacttcgtacaaaaaaaggcagagccatttgaaaagacagatggaaggtttccatgctatcttaaataacagatattcattataaaatgggatcagcactttccatcctttttcaccagctttgcaaaaaattccccaatagccgatgactgttaatatcagtaaacatactgccatcaggaataaaatgatcaggattgcataatcttccatatctcctccatcaaatagggaaagcctgttggctctccctatttactcttgtttaaaa
